US011634459B2

(12) United States Patent
Kinney

(10) Patent No.: US 11,634,459 B2
(45) Date of Patent: Apr. 25, 2023

(54) CHIMERIC REPORTER WEST NILE/DENGUE VIRUSES AND THEIR USE

(71) Applicant: The U.S.A., as represented by the Secretary, Department of Health and Human Services, Bethesda, MD (US)

(72) Inventor: Claire Y. Kinney, Fort Collins, CO (US)

(73) Assignee: The United States of America, as represented by the Secretary, Department of Health and Human Services, Bethesda, MD (US)

( * ) Notice: Subject to any disclaimer, the term of this patent is extended or adjusted under 35 U.S.C. 154(b) by 456 days.

(21) Appl. No.: 16/639,652

(22) PCT Filed: Aug. 17, 2018

(86) PCT No.: PCT/US2018/046909
§ 371 (c)(1),
(2) Date: Feb. 17, 2020

(87) PCT Pub. No.: WO2019/036617
PCT Pub. Date: Feb. 21, 2019

(65) Prior Publication Data
US 2020/0255479 A1 Aug. 13, 2020

Related U.S. Application Data

(60) Provisional application No. 62/547,527, filed on Aug. 18, 2017.

(51) Int. Cl.
*C12N 15/00* (2006.01)
*C07K 14/18* (2006.01)
(Continued)

(52) U.S. Cl.
CPC ............ *C07K 14/1825* (2013.01); *C12N 7/00* (2013.01); *C12Q 1/701* (2013.01); *C12N 2770/24122* (2013.01); *C12N 2770/24141* (2013.01)

(58) Field of Classification Search
None
See application file for complete search history.

(56) References Cited

U.S. PATENT DOCUMENTS 8,691,961 B1 4/2014 Puffer et al.
8,715,689 B2 5/2014 Kinney et al.

FOREIGN PATENT DOCUMENTS

WO WO 2015/196094 12/2015
WO WO 2018/009603 1/2018

OTHER PUBLICATIONS

Gadea et al., "A Robust Method for the Rapid Generation of Recombinant Zika Virus Expressing the GFP Reporter Gene," *Virol.*, vol. 497:157-162, 2016.

(Continued)

*Primary Examiner* — M Franco G Salvoza
(74) *Attorney, Agent, or Firm* — Klarquist Sparkman, LLP

(57) ABSTRACT

Chimeric flaviviruses engineered to contain a reporter gene and chimeric nucleic acid molecules encoding the chimeric flaviviruses are described. The chimeric flaviviruses further include genomic non-coding regions, non-structural proteins, and at least a portion of a capsid (C) protein from West Nile virus (WNV), and premembrane (prM) and envelope (E) proteins from dengue virus (DENV). Diagnostic assays that utilize chimeric West Nile/dengue viruses are further described.

29 Claims, 5 Drawing Sheets

Specification includes a Sequence Listing.

(51) Int. Cl.
*C12N 7/00* (2006.01)
*C12Q 1/70* (2006.01)

(56) References Cited

OTHER PUBLICATIONS

Ong et al., "Chimeric Reporter Viruses for Fast and High Throughput Micro-Neutralization Assays for Zika and Dengue Viruses," Poster at the $65^{th}$ Annual Meeting of the American Society of Tropical Medicine and Hygiene (ASTMH), presented Nov. 15, 2016.

Ong et al., "Chimeric Reporter Viruses for Fast and High Throughput Micro-Neutralization Assays for Zika and Dengue Viruses," Abstract submitted to the $65^{th}$ Annual Meeting of the American Society of Tropical Medicine and Hygiene (ASTMH), published Oct. 24, 2016.

Schoggins et al., "Dengue Reporter Viruses Reveal Viral Dynamics in Interferon Receptor-Deficient Mice and Sensitivity to Interferon Effectors in Vitro," *Proc. Natl. Acad. Sci. USA*, vol. 109:14610-14615, 2012.

Suzuki et al., "Construction and Characterization of a Single-Cycle Chimeric Flavivirus Vaccine Candidate that Protects Mice against Lethal Challenge with Dengue Virus Type 2," *J. Virol.*, vol. 83:1870-1880, 2009.

Zhang et al., "Generation of a Recombinant West Nile Virus Stably Expressing the *Gaussia* Luciferase for Neutralization Assay," Virus Res., vol. 211:17-24, 2016.

FIG. 2

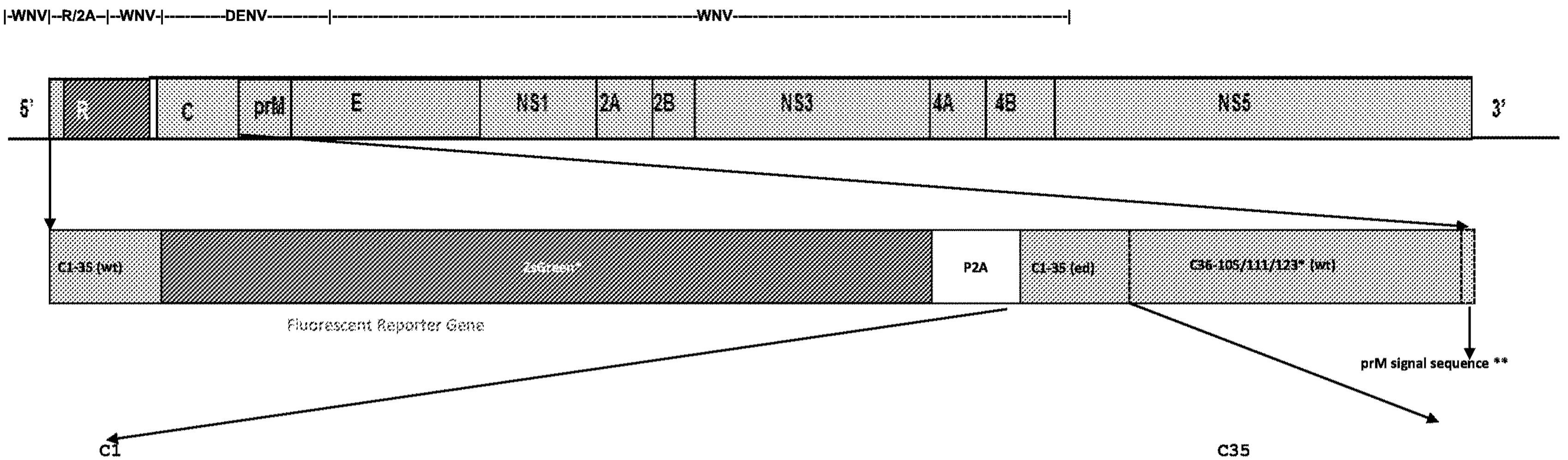

C1 ... C35

M S K K P G G P G K S R A V N M L K R G M P R V L S L I G L K R A M L

Wt ATGTCTAAGAAACCAGGAGGGCCCGGCAAGAGCCGGGCTGTCAATATGCTAAAACGCGGAATGCCCCGCGTGTTGTCCTTGATTGGACTGAAGAGGGCTATGTTG SEQ ID NO: 25, SEQ ID No: 26

Edit ATGTC[illegible]AA[illegible]AA[illegible]CC[illegible]GG[illegible]GG[illegible]CC[illegible]GG[illegible]AA[illegible]CA[illegible]G[illegible]GC[illegible]GT[illegible]AA[illegible]ATG[illegible]T[illegible]AAA[illegible]G[illegible]GG[illegible]ATGCC[illegible]CG[illegible]GT[illegible]TG[illegible]TGAT[illegible]GG[illegible]CT[illegible]AA[illegible]AGAGC[illegible]ATGTTG SEQ ID No: 27

The first 35 AA (1-35) was edited to maintain AA sequence but change the Nt sequences (in red font) as much as possible in the R-WN/ZKV to minimize homologous recombination deletion with the C1-35 portion in front of the ZsGreen gene.

*Codon-optimized ZdGreen gene was used in WN/DENV-4 CO construct, while all other R-WN/DENV constructs contain wild-type ZsGreen gene sequence

**prM signal sequence (C/prM junction:
- R-WN/DENV-1: WNV C105/DENV-1 C101
- R-WN/DENV-2: WNV C105/DENV-2 C101
- R-WN/DENV-3BE345: WNV C111/DENV-3 C101
- R-WN/DENV-3CE345: WNV C123/DENV-3 prM1
- R-WN/DENV-4: WNV C105/DENV-4 C100 (same junction for both R-WN/DENV-4 and R-WN/DENV-4 CO)

CHIMERIC REPORTER WEST NILE/DENGUE VIRUSES AND THEIR USE

CROSS REFERENCE TO RELATED APPLICATIONS

This application is the U.S. National Stage of International Application No. PCT/US2018/046909, filed Aug. 17, 2018, which was published in English under PCT Article 21(2), which claims the benefit of U.S. Application No. 62/547,527, filed Aug. 18, 2017, which is herein incorporated by reference in its entirety.

FIELD

This disclosure concerns chimeric flaviviruses engineered to contain a reporter gene, such as for use in improved flavivirus diagnostic assays.

BACKGROUND

Dengue viruses (DENV) are the most prevalent arthropod-borne viral pathogens infecting humans. These mosquito-transmitted viruses, members of the Flaviviridae, are endemic to most tropical and sub-tropical countries with nearly half of the world's population living at risk of DENV infection and resulting in over one million estimated infections annually (Mackenzie et al., *Nat Med* 10:S98-109, 2004; Gubler, *Arch Med Res* 33:330-342, 2002). Infection with DENV can cause a broad range of symptoms, ranging from subclinical, to the self-limiting flu-like illness dengue fever (DF), to the more severe and life-threatening dengue hemorrhagic fever and shock syndrome (DHF/DSS) characterized by increased vascular permeability producing plasma leakage, severe thrombocytopenia and hypotension leading to circulatory collapse (Gubler, *Novartis Found Symp* 277:3-16; discussion 16-22, 71-13, 251-253, 2006). DENV prevalence, infection rates, and disease severity have increased exponentially since the middle of the last century (Guzman et al., *Nat Rev Microbiol* 8:S7-S16, 2010).

Although DENV and West Nile virus (WNV) are both flaviviruses, DENV replicates much more slowly and to lower titers than WNV in cell culture. This makes production of dengue viruses or dengue viral antigens, such as for development of DENV vaccines or diagnostic assays, more difficult than for WNV. Neutralization tests (NT), such as plaque and micro-focus reduction neutralization tests (PRNT and mFRNT), are critical tests for DENV diagnostic assays and vaccine studies. However, because wild-type DENV replicates slowly, PRNT is time-consuming. Thus, a need exists for a more rapid and high-throughput method for DENV diagnostics.

SUMMARY

Described herein are chimeric flaviviruses engineered to contain a reporter gene and chimeric nucleic acid molecules encoding the chimeric flaviviruses. The chimeric reporter viruses (CRVs) include non-coding regions, at least a portion of a capsid (C) protein and non-structural proteins from West Nile virus (WNV); a premembrane (prM) protein and an envelope (E) protein from dengue virus (DENV); and a heterologous reporter gene. Diagnostic assays that utilize the disclosed chimeric reporter West Nile/dengue viruses (R-WN/DENVs) are also described.

Provided herein is a chimeric flavivirus nucleic acid molecule comprising in the 5' to 3' direction: a 5' non-coding region from a WNV genome; a nucleic acid encoding amino acid residues 1-35 of a capsid (C) protein of the WNV; a reporter gene; a nucleic acid encoding a 2A proteolytic site; a nucleic acid encoding a flavivirus C protein; a nucleic acid encoding a prM protein and an E protein from the DENV; a nucleic acid encoding non-structural proteins NS1, NS2A, NS2B, NS3, NS4A, NS4B and NS5 from the WNV; and a 3' non-coding region from the WNV genome.

In some embodiments, the nucleic acid encoding the flavivirus C protein includes a 5' portion encoding amino acid residues 1-35 of a C protein of the WNV, wherein the 5' portion comprises at least one silent mutation; and a 3' portion encoding amino acid residue 36 to the C-terminal most amino acid residue of the flavivirus C protein, wherein the 3' portion comprises a WNV premembrane (prM) signal sequence, a DENV prM signal sequence or a chimeric WNV/DENV prM signal sequence.

In some embodiments, the reporter gene encodes a fluorescent protein.

Recombinant flaviviruses comprising a chimeric flavivirus nucleic acid molecule disclosed herein are further provided.

Also provided are kits comprising a chimeric flavivirus nucleic acid molecule or a recombinant flaviviruses disclosed herein.

Further provided is a method of detecting dengue virus-specific antibodies in a biological sample. In some embodiments, the method includes contacting the sample with a recombinant flavivirus disclosed herein to form a virus-sample mixture, wherein virus-antibody complexes are formed in the virus-sample mixture if dengue virus antibodies are present in the sample; inoculating a cell culture with the virus-sample mixture under conditions sufficient to allow infection of the cell culture by virus not blocked by neutralizing antibodies and subsequent expression of the reporter gene; and detecting a decrease in expression of the reporter gene in the cell culture as compared to a cell culture inoculated with the recombinant virus contacted with a control sample, thereby detecting dengue virus-specific antibody in the sample.

The foregoing and other objects, features, and advantages of the invention will become more apparent from the following detailed description, which proceeds with reference to the accompanying figures.

(nucleotides 1267-1341 of SEQ ID NO: 3; amino acids 391-415 of SEQ ID NO: 4), WN/DENV-3 (SEQ ID NO: 23 and SEQ ID NO: 24), WN/DENV-4 (nucleotides 1267-1341 of SEQ ID NO: 9; amino acids 391-415 of SEQ ID NO: 10), WN/DENV-3 BE 345 (nucleotides 1267-1353 of SEQ ID NO: 5; amino acids 391-419 of SEQ ID NO: 6) and WN/DENV-3 CE345 (nucleotides 1267-1353 of SEQ ID NO: 7; amino acids 391-419 of SEQ ID NO: 8).

FIG. 2 is a schematic of the chimeric reporter West Nile/dengue viruses (R-WN/DENVs). The reporter cassette, including reporter gene ZsGreen and a P2A peptide encoding sequence, is inserted 5' of a complete C gene. A partial C gene encoding the first 35 amino acids is added 5' of the reporter cassette. The partial C gene provides a critical cyclization sequence connected to the 5' non-coding region for competent virus replication. The first 35 amino acids in the complete C gene ($C_{ed}$) is codon edited with silent mutations to minimize homologous recombination potential with the partial C gene. The amino acid position of the C/prM junction site for each reporter virus is provided.

Figure 3:
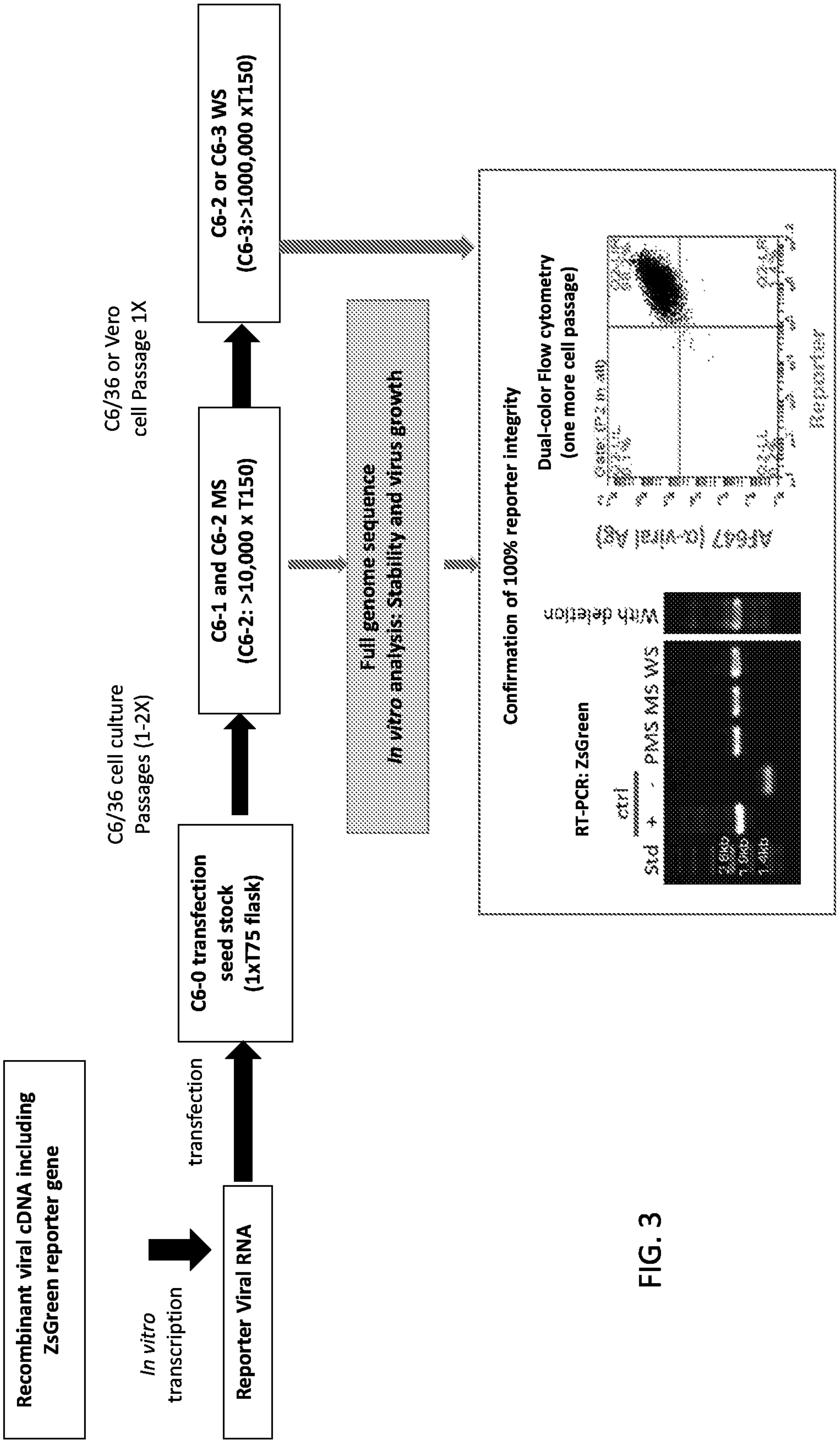

FIG. 3 includes a schematic of the production and quality control of R-WN/DENV seed lots. The R-WN/DENVs were initially derived from C6/36 cells transfected with RNA transcribed from recombinant cDNA. The transfection seed was amplified 1-2 times in cells to generate pre-master seed (PMS) and master seed (MS) lots. Each MS lot was fully sequenced and verified by RT-PCR and dual-color flow cytometry for ZsGreen integrity before it was used for working seed (WS) lot production. The WS lots were made from a single cell passage from the MS, and each lot was verified for ZsGreen integrity prior to experiment use. For smaller scale production, 1 passage from the transfection seed was used directly as MS (C6-1) to produce sufficient C6-2 as WS.

Figure 4:
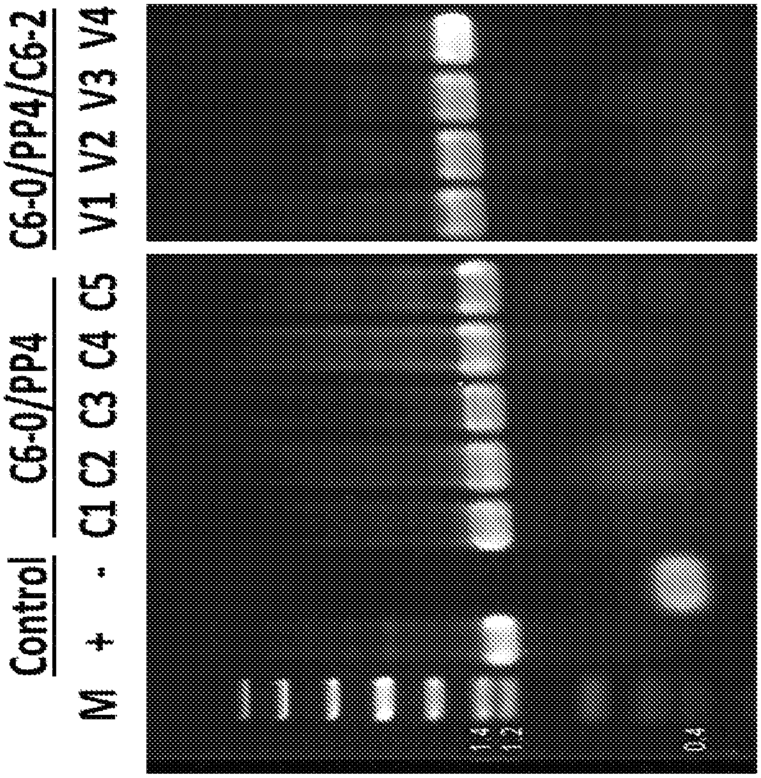
Figure 4A:
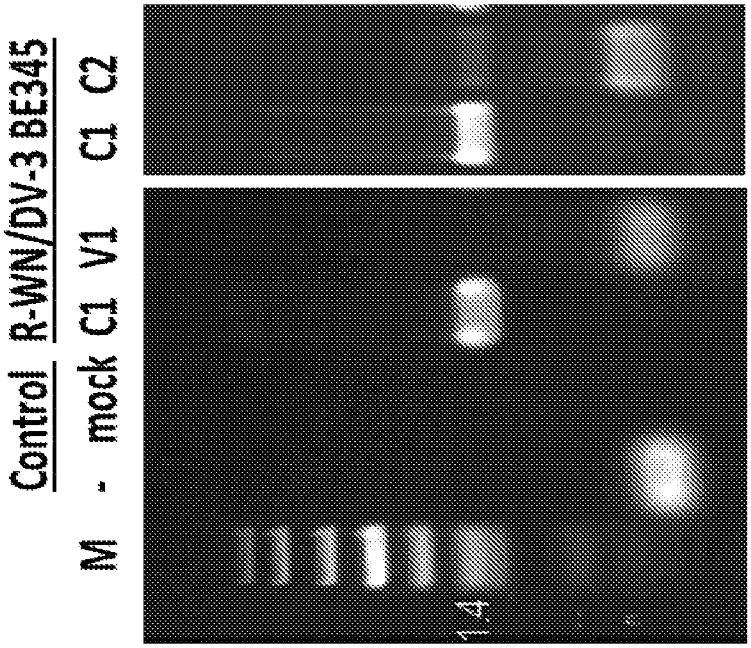

FIGS. 4A-4B show exemplary RT-PCR gel images in analysis of ZsGreen genetic stability in R-WN/DENV-3 BE345 stocks. (FIG. 4A) Original R-WN/DENV-3 BE345. The ZsGreen gene was intact after the first C6/36 cell transfection culture (C6-0 seed, shown in the C1 lane). The ZsGreen gene appeared to be fully deleted in the first Vero cell passage (V1) and in the majority portion of the virus harvested from the $2^{nd}$ C6/36 culture (C2). (FIG. 4B) R-WN/DENV-3 BE345 C6-0/PP4 isolate. Full-length ZsGreen was maintained in the harvested stocks from serially passaged C6/36 cultures for up to 5 times (C1-C5). The C6-0/PP4/C6-2 harvest stock was then used for serial passages in Vero cells for up to 4 times (V1-V4) and all passages retained intact ZsGreen gene. M: marker; Control (−): chimeric cDNA plasmid without ZsGreen insertion; Control (+): chimeric reporter viral cDNA plasmid; Control (mock): culture supernatant from un-infected cells.

Figures 5, 5B, 5C:
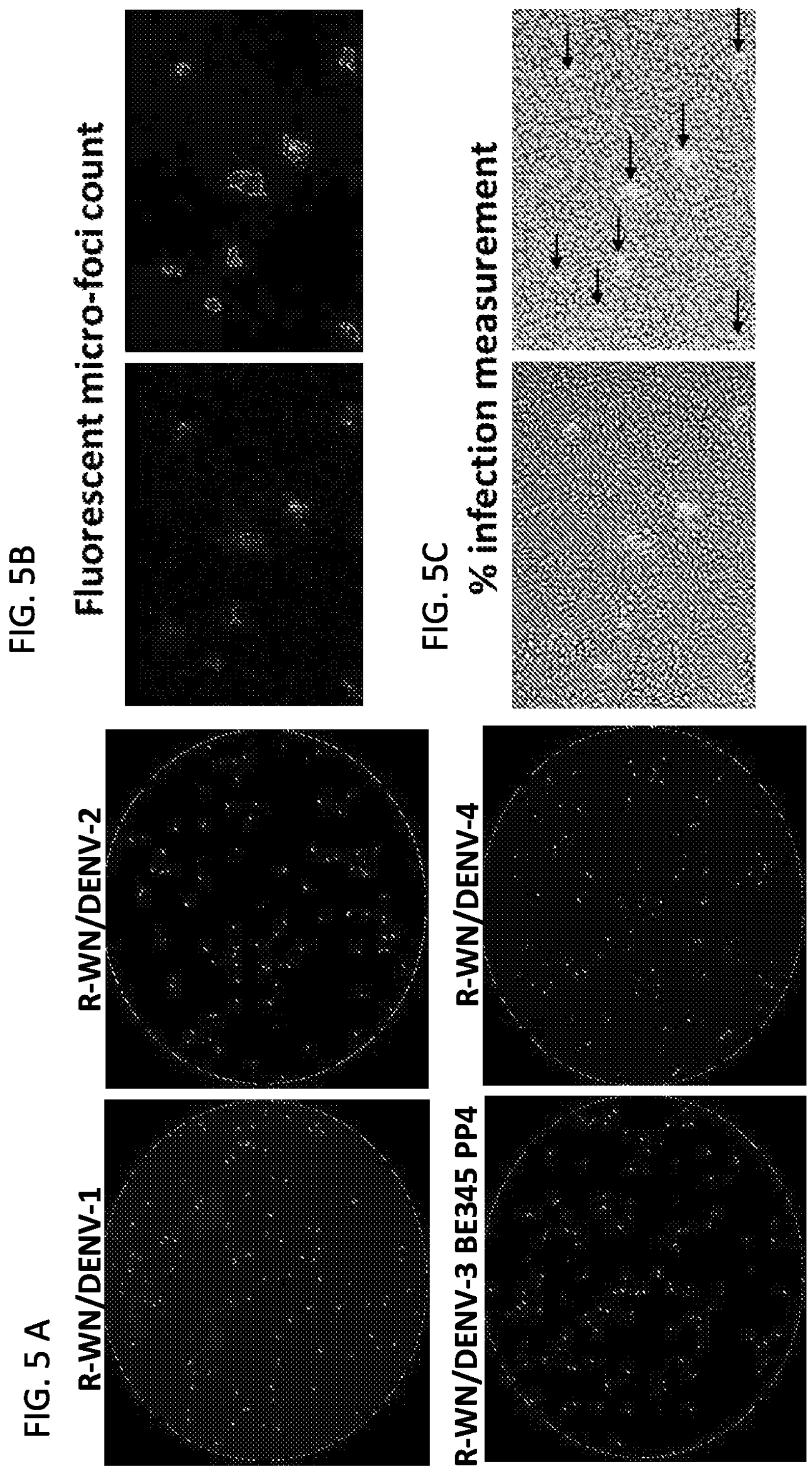

FIGS. 5A-5C: Reporter viral foci image and counting by Celigo image-based cytometer. (FIG. 5A) Live-image of the viral foci expressing ZsGreen fluorescent protein at 24-26 hours post-infection of Vero cells in 96-well plates. Each sample image was from a single well. (FIG. 5B) Use of Celigo for automatic foci counting. Each counted foci (marked by circles) contained multiple infected cells resulting from 1 ffu of virus infection. (FIG. 5C) Automatic Celigo analysis and counting for percent cell infection. The bright field image was used for total cell counts and the florescent image was used to count infected cells. Left panel: Merged image of bright field and fluorescent images. Right panel: Auto single-cell analysis. Arrows points to ZsGreen-positive cells (infected cells).

SEQUENCE LISTING

The nucleic and amino acid sequences listed in the accompanying sequence listing are shown using standard letter abbreviations for nucleotide bases, and three letter code for amino acids, as defined in 37 C.F.R. 1.822. Only one strand of each nucleic acid sequence is shown, but the complementary strand is understood as included by any reference to the displayed strand. The Sequence Listing is submitted as an ASCII text file, created on Feb. 11, 2020, 796 KB, which is incorporated by reference herein. In the accompanying sequence listing:

SEQ ID NO: 1 is the nucleotide sequence of the R-WN/DENV-1 genome.

SEQ ID NO: 2 is the amino acid sequence of the R-WN/DENV-1 polyprotein.

SEQ ID NO: 3 is the nucleotide sequence of the R-WN/DENV-2 genome.

SEQ ID NO: 4 is the amino acid sequence of the R-WN/DENV-2 polyprotein.

SEQ ID NO: 5 is the nucleotide sequence of the R-WN/DENV-3 BE 345 genome.

SEQ ID NO: 6 is the amino acid sequence of the R-WN/DENV-3 BE 345 polyprotein.

SEQ ID NO: 7 is the nucleotide sequence of the R-WN/DENV-3 CE 345 genome.

SEQ ID NO: 8 is the amino acid sequence of the R-WN/DENV-3 CE 345 polyprotein.

SEQ ID NO: 9 is the nucleotide sequence of the R-WN/DENV-4 genome.

SEQ ID NO: 10 is the amino acid sequence of the R-WN/DENV-4 polyprotein.

SEQ ID NO: 11 is the nucleotide sequence of the R-WN/DENV-4 CO genome.

SEQ ID NO: 12 is the amino acid sequence of the R-WN/DENV-4 CO polyprotein.

SEQ ID NOs: 13 and 14 are nucleotide and amino acid sequences of the WNV NY99 C/prM junction.

SEQ ID NOs: 15 and 16 are nucleotide and amino acid sequences of the DENV-1 16007 C/prM junction.

SEQ ID NOs: 17 and 18 are nucleotide and amino acid sequences of the DENV-2 16681 C/prM junction.

SEQ ID NOs: 19 and 20 are nucleotide and amino acid sequences of the DENV-3 16562 C/prM junction.

SEQ ID NOs: 21 and 22 are nucleotide and amino acid sequences of the DENV-4 1036 C/prM junction.

Figure 1:
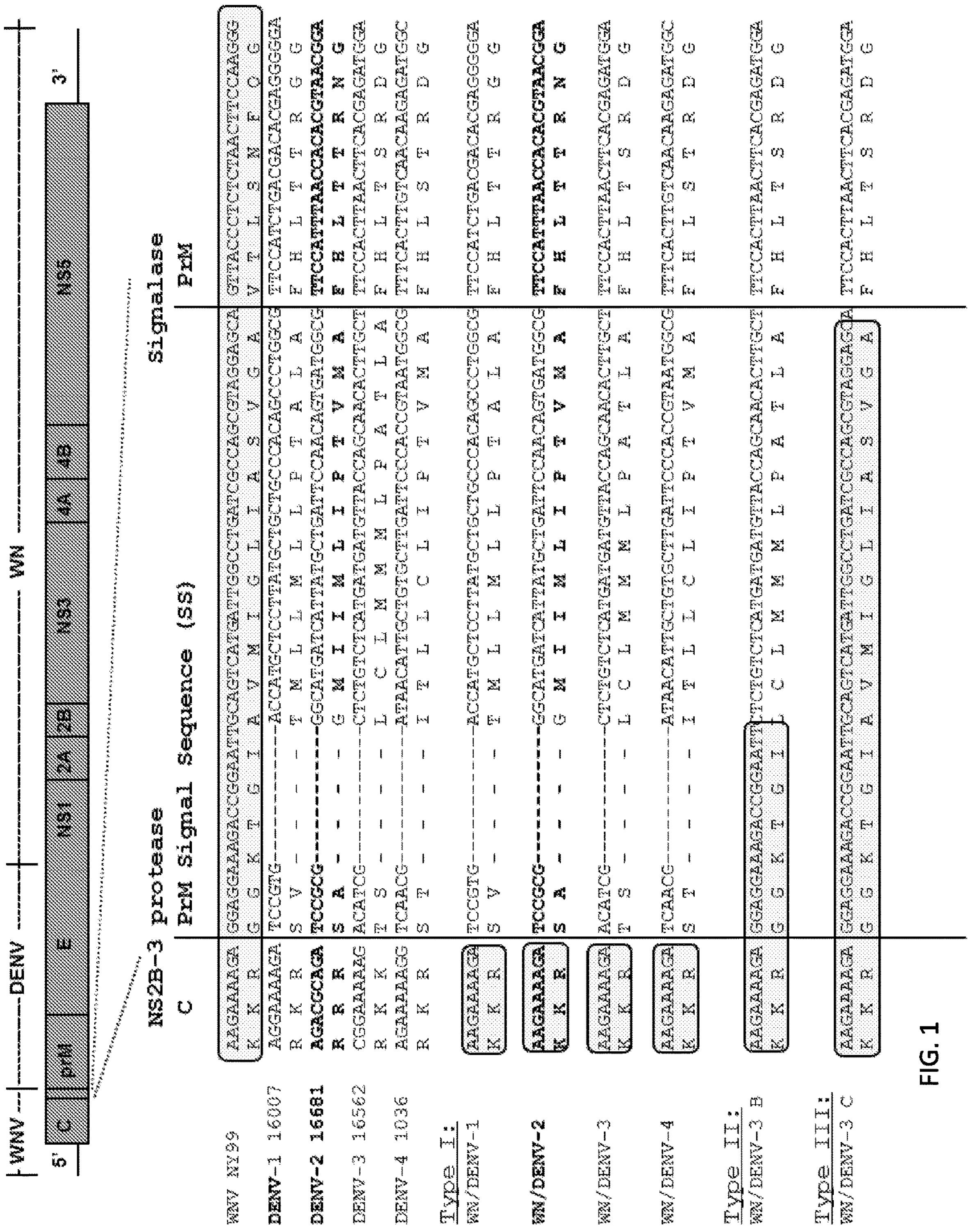
FIG. 1 shows the genomic structure of chimeric WN/DEN viruses (without a reporter gene). Chimeric viruses contain prM/E of DENV in the genomic backbone of WNV. The C/prM junction site is enlarged to show the three different junction strategies. In the Type I constructs, the prM signal sequence is from DENV. In the Type III constructs, the prM signal sequence is from WNV. The prM signal sequence of Type II constructs contains sequence from both DENV and WNV. The NS2B-3 protease cleavage and signalase cleavage sites are also indicated. WNV (NY99) nucleotide and amino acid sequences are circled; the nucleotide and amino acid sequences of wild-type DENV-1, DENV-2, DENV-3 and DENV-4 are not circled. The sequences shown include WNV NY99 (SEQ ID NO: 13 and SEQ ID NO: 14), DENV-1 16007 (SEQ ID NO: 15 and SEQ ID NO: 16), DENV-2 16681 (SEQ ID NO: 17 and SEQ ID NO: 18), DENV-3 16562 (SEQ ID NO: 19 and SEQ ID NO: 20), DENV-4 1036 (SEQ ID NO: 21 and SEQ ID NO: 22), WN/DENV-1 (nucleotides 1267-1341 of SEQ ID NO: 1; amino acids 391-415 of SEQ ID NO: 2), WN/DENV-2

SEQ ID NOs: 23 and 24 are the nucleotide and amino acid sequences of WN/DENV-3 C/prM junction shown in FIG. 1.

SEQ ID NO: 25 is the amino acid sequence of the first 35 residues of the WNV NY99 C protein (see FIG. 2).

SEQ ID NO: 26 is the nucleotide sequence encoding the first 35 residues of the WNV NY99 C protein (see FIG. 2).

SEQ ID NO: 27 is a codon edited nucleotide sequence encoding the first 35 residues of the WNV NY99 C protein (see FIG. 2).

SEQ ID NO: 28 is the nucleotide sequence of the R-WN/DENV-2 PP4 isolate genome.

SEQ ID NO: 29 is the amino acid sequence of the R-WN/DENV-2 PP4 isolate polyprotein.

SEQ ID NO: 30 is the nucleotide sequence of the R-WN/DENV-3 BE PP4 isolate genome.

SEQ ID NO: 31 is the amino acid sequence of the R-WN/DENV-3 BE PP4 isolate polyprotein.

SEQ ID NO: 32 is the nucleotide sequence of the R-WN/DENV-4 PP1 isolate genome.

SEQ ID NO: 33 is the amino acid sequence of the R-WN/DENV-4 PP1 isolate polyprotein.

DETAILED DESCRIPTION

I. Abbreviations

- C capsid
- CRV chimeric reporter virus
- DENV dengue virus
- E envelope
- ffu fluorescent foci unit
- mFRNT micro-focus reduction neutralization test
- NS non-structural
- NT neutralization test
- prM premembrane
- PRNT plaque reduction neutralization test
- WNV West Nile virus II. Terms and Methods Unless otherwise noted, technical terms are used according to conventional usage. Definitions of common terms in molecular biology may be found in Benjamin Lewin, *Genes V, published by Oxford University Press,* 1994 (ISBN 0-19-854287-9); Kendrew et al. (eds.), *The Encyclopedia of Molecular Biology,* published by Blackwell Science Ltd., 1994 (ISBN 0-632-02182-9); and *Robert A. Meyers* (ed.), *Molecular Biology and Biotechnology: a Comprehensive Desk Reference,* published by VCH Publishers, Inc., 1995 (ISBN 1-56081-569-8).

In order to facilitate review of the various embodiments of the disclosure, the following explanations of specific terms are provided:

Biological sample: A sample obtained from a subject (such as a human or veterinary subject). Biological samples, include, for example, fluid, cell and/or tissue samples. In some embodiments herein, the biological sample is a fluid sample. Fluid sample include, but are not limited to, serum, blood, plasma, urine, feces, saliva, cerebral spinal fluid (CSF) and bronchoalveolar lavage (BAL) fluid.

Capsid protein (C protein): A flavivirus structural protein that functions to package viral RNA into the nucleocapsid core during virus assembly. The C-terminal portion of the C protein includes an internal signal sequence (referred to herein as either C(ss) or prM signal sequence) for translocation of the prM protein into the endoplasmic reticulum, where cleavage of the C and prM proteins occurs. This signal sequence varies in length among different flaviviruses. For example, the C(ss) of WNV is 18 amino acids, while the C(ss) of DEN viruses is 14 amino acids.

Chimera: A molecule (e.g., nucleic acid or protein) composed of parts that are of different origin (such as at least two nucleic acids or polypeptides) that, while typically unjoined in their native state, are joined or linked to form a single continuous molecule. A chimera may include nucleic acids or polypeptides that are joined end-to-end (for example, the amino-terminus of one sequence is joined to the carboxyl-terminus of a second sequence) or may include a sequence from one molecule that is embedded within that of another molecule (for example, the amino-terminus and carboxyl-terminus of the chimera are from one molecule, while an intervening sequence comes from another molecule).

A chimera may include a chimeric protein, for example a protein that is composed of amino acids from more than one protein. A chimera may also include a chimeric nucleic acid composed of nucleic acid sequences from more than one source, such as a chimeric nucleic acid which encodes a chimeric protein. In other examples, a chimera may include a chimeric genome, such as a flavivirus genome, which is composed of sequences from two or more flaviviruses. For example, a chimeric flavivirus genome may comprise nucleic acid sequences from more than one flavivirus genome, such as a West Nile virus and a dengue virus. In some examples, a chimeric flavivirus includes nucleic acids encoding one or more proteins from a first flavivirus and nucleic acids encoding one or more proteins from a second flavivirus. In particular examples, a chimeric flavivirus is composed of a nucleic acid encoding the non-structural proteins and a C protein or a portion thereof from a West Nile virus genome linked to a nucleic acid encoding a prM protein and E protein (and optionally a portion of a C protein) from a dengue virus genome.

Conservative substitution: A substitution of one amino acid residue in a protein sequence for a different amino acid residue having similar biochemical properties. Typically, conservative substitutions have little to no impact on the activity of a resulting polypeptide. For example, ideally, a flavivirus protein (such as a prM, E, or non-structural protein) including one or more conservative substitutions (for example 1-10, 2-5, or 10-20, or no more than 2, 5, 10, 20, 30, 40, or 50 substitutions) retains the structure and function of the wild-type protein. A polypeptide can be produced to contain one or more conservative substitutions by manipulating the nucleotide sequence that encodes that polypeptide using, for example, standard procedures such as site-directed mutagenesis or PCR. In one example, such variants can be readily selected for additional testing by infecting cells with a virus containing a variant protein and determining its ability to replicate or other properties, and/or by testing antibody cross-reactivity.

Contacting: Placement in direct physical association; includes both in solid and liquid form. "Contacting" is often used interchangeably with "exposed." In some cases, "contacting" includes transfecting, such as transfecting a nucleic acid molecule into a cell. In other examples, "contacting" refers to incubating a molecule (such as an antibody) with a biological sample.

Control: A reference standard, for example a positive control or negative control. A positive control is known to provide a positive test result. A negative control is known to provide a negative test result. However, the reference standard can be a theoretical or computed result, for example a result obtained in a population.

Dengue virus (DENV): An RNA virus of the family Flaviviridae, genus Flavivirus. The dengue virus genome encodes the three structural proteins (C, prM and E) that form the virus particle and seven non-structural proteins (NS1, NS2a, NS2b, NS3, NS4a, NS4b, NS5) that are only found in infected host cells, but are required for replication of the virus. There are four serotypes of dengue virus, referred to as DENV-1, DENV-2, DENV-3 and DENV-4. All four serotypes can cause the full spectrum of dengue disease. Infection with one serotype can produce lifelong immunity to that serotype. However, severe complications can occur upon subsequent infection by a different serotype. Dengue virus is primarily transmitted by Aedes mosquitoes, particularly *A. aegypti.* Symptoms of dengue virus infection include fever, headache, muscle and joint pain and a skin rash similar to measles. In a small percentage of cases, the infection develops into a life-threatening dengue hemorrhagic fever, typically resulting in bleeding, low platelet levels and blood plasma leakage, or into dengue shock syndrome characterized by dangerously low blood pressure.

Envelope glycoprotein (E protein): A flavivirus structural protein that mediates binding of flavivirus virions to cellular receptors on host cells. The flavivirus E protein is required for membrane fusion, and is the primary antigen inducing protective immunity to flavivirus infection. Flavivirus E protein affects host range, tissue tropism and viral virulence.

The flavivirus E protein contains three structural and functional domains, DI, DII and DIII. In mature virus particles the E protein forms head to tail homodimers lying flat and forming a dense lattice on the viral surface.

Flavivirus non-structural protein: There are seven non-structural (NS) proteins of a flavivirus, NS1, NS2A, NS2B, NS3, NS4A, NS4B, and NS5, which are encoded by the portion of the flavivirus genome that is 3' to the structural proteins. NS1 has been implicated in RNA replication and has been shown to be secreted from infected mammalian cells (Post et al., *Virus Res.* 18:291-302, 1991; Mackenzie et al., *Virology* 220:232-240, 1996; Muylaert et al., *Virology* 222:159-168, 1996). NS1 can elicit strong humoral immune responses and is a potential vaccine candidate (Shlesinger et al., *J. Virol.* 60:1153-1155, 1986; Qu et al., *J. Gen. Virol.* 74:89-97, 1993). NS2 is cleaved into NS2A and NS2B. NS2A is involved in RNA replication and virus particle assembly and secretion and NS2B forms a complex with NS3 and functions as a cofactor for the NS3 protease, which cleaves portions of the virus polyprotein. NS3 also functions as an RNA helicase and is used to unwind viral RNA during replication (Li et al., *J. Virol.* 73:3108-3116, 1999). While the exact functions of NS4A and NS4B remain to be elucidated, they are thought to be involved in RNA replication and RNA trafficking (Lindenbach and Rice, In: *Fields Virology,* Knipe and Howley, eds., Lippincott, Williams, and Wilkins, 991-1041, 2001). Finally, the NS5 protein is an RNA-dependent RNA polymerase involved in genome replication (Rice et al., *Science* 229:726-733, 1985). NS5 also shows methyltransferase activity commonly found in RNA capping enzymes (Koonin, *J. Gen. Virol.* 74:733-740, 1993).

Flavivirus structural protein: The capsid (C), premembrane (prM), and envelope (E) proteins of a flavivirus are the viral structural proteins. Flavivirus genomes consist of positive-sense RNAs that are roughly 11 kb in length. The genome has a 5' cap, but lacks a 3' polyadenylated tail (Wengler et al., *Virology* 89:423-437, 1978) and is translated into one polyprotein. The structural proteins (C, prM, and E) are at the amino-terminal end of the polyprotein followed by the non-structural proteins (NS1-5). The polyprotein is cleaved by virus and host derived proteases into individual proteins. The C protein forms the viral capsid while the prM and E proteins are embedded in the surrounding envelope (Russell et al., *The Togaviruses: Biology, Structure, and Replication,* Schlesinger, ed., Academic Press, 1980). The E protein functions in binding to host cell receptors resulting in receptor-mediated endocytosis. In the low pH of the endosome, the E protein undergoes a conformational change causing fusion between the viral envelope and the endosomal membranes. The prM protein is believed to stabilize the E protein until the virus exits the infected cell, at which time prM is cleaved to the mature M protein (Reviewed in Lindenbach and Rice, In: *Fields Virology*, Knipe and Howley, eds., Lippincott, Williams, and Wilkins, 991-1041, 2001).

Fluorescent protein: A protein that emits light of a certain wavelength when exposed to a particular wavelength of light. Fluorescent proteins include, but are not limited to, green fluorescent proteins (such as GFP, EGFP, AcGFP1, Emerald, Superfolder GFP, Azami Green, mWasabi, TagGFP, TurboGFP and ZsGreen), blue fluorescent proteins (such as EBFP, EBFP2, Sapphire, T-Sapphire, Azurite and mTagBFP), cyan fluorescent proteins (such as ECFP, mECFP, Cerulean, CyPet, AmCyan1, Midori-Ishi Cyan, mTurquoise and mTFP1), yellow fluorescent proteins (EYFP, Topaz, Venus, mCitrine, YPet, TagYFP, PhiYFP, ZsYellow1 and mBanana), orange fluorescent proteins (Kusabira Orange, Kusabira Orange2, mOrange, mOrange2 and mTangerine), red fluorescent proteins (mRuby, mApple, mStrawberry, AsRed2, mRFP1, JRed, mCherry, HcRed1, mRaspberry, dKeima-Tandem, HcRed-Tandem, mPlum, AQ143, tdTomato and E2-Crimson), orange/red fluorescence proteins (dTomato, dTomato-Tandem, TagRFP, TagRFP-T, DsRed, DsRed2, DsRed-Express (T1) and DsRed-Monomer) and modified versions thereof.

Heterologous: Originating from a different genetic sources or species. For example, a chimeric nucleic acid including nucleic acid from two (or more) different genetic sources or from two (or more) otherwise separated segments of sequence from a single genetic source is considered a heterologous nucleic acid. Similarly, a polypeptide including peptides from two (or more) different proteins from a single genetic source or two (or more) proteins from different genetic sources (such as a fusion protein) is considered a heterologous polypeptide. For example, a nucleic acid comprising portions of a WNV genome operably linked to a nucleic acid comprising portions of a DENV genome is a heterologous nucleic acid. Similarly, a polypeptide including a WNV polypeptide or portion thereof linked to a DENV polypeptide or portion thereof is a heterologous polypeptide.

In another example of use of the term heterologous, a nucleic acid that is heterologous to a cell originates from an organism or species other than the cell in which it is expressed. In one specific, non-limiting example, a heterologous nucleic acid includes a flavivirus nucleic acid that is present or expressed in a bacterial cell (such as an *E. coli* cell) or in an algal, plant, insect (e.g. C6/36), or mammalian (e.g., Vero) cell. Methods for introducing a heterologous nucleic acid into bacterial, algal, plant, insect, and mammalian cells are well known in the art, including infection of a cell with a viral nucleic acid, or transformation with a nucleic acid, for example electroporation, lipofection, and particle gun acceleration.

Isolated: An “isolated” or “purified” biological component (such as a nucleic acid, peptide, protein, protein complex, particle or virus) has been substantially separated, produced apart from, or purified away from other components in a preparation or other biological components in the cell of the organism in which the component occurs, that is, other chromosomal and extrachromosomal DNA and RNA, and proteins. Nucleic acids, peptides and proteins that have been “isolated” or “purified” thus include nucleic acids and proteins purified by standard purification methods. The term also embraces nucleic acids, peptides and proteins prepared by recombinant expression in a host cell, as well as chemically synthesized nucleic acids or proteins. The term “isolated” or “purified” does not require absolute purity; rather, it is intended as a relative term. Thus, for example, an isolated biological component is one in which the biological component is more enriched than the biological component is in its natural environment within a cell, or other production vessel. Preferably, a preparation is purified such that the biological component represents at least 50%, such as at least 70%, at least 90%, at least 95%, or greater, of the total biological component content of the preparation.

Light-emitting protein: Any protein that is capable of emitting light or inducing the emission of light by acting on a particular substrate. Light-emitting proteins include, for example, fluorescent proteins and bioluminescent proteins. Fluorescent proteins include, for example, green fluorescent proteins and variants thereof (including blue, cyan, yellow, orange and red fluorescent proteins) and phycobiliproteins, such as B-phycoerythrin (B-PE), R-phycoerythrin (R-PE) and allophycocyanin (APC). Bioluminescent proteins include, for example, aequorin and luciferase (which acts on the substrate luciferin to emit light).

Nucleic acid molecule: A polymeric form of nucleotides, which may include both sense and anti-sense strands of RNA, cDNA, genomic DNA, and synthetic forms and mixed polymers of the above. A nucleotide refers to a ribonucleotide, deoxynucleotide or a modified form of either type of nucleotide. The term "nucleic acid molecule" as used herein is synonymous with "nucleic acid" and "polynucleotide." A nucleic acid molecule is usually at least 10 bases in length, unless otherwise specified. The term includes single- and double-stranded forms of DNA. A polynucleotide may include either or both naturally occurring and modified nucleotides linked together by naturally occurring and/or non-naturally occurring nucleotide linkages.

Operably linked: A first nucleic acid is operably linked to a second nucleic acid when the first nucleic acid is placed in a functional relationship with the second nucleic acid. Generally, operably linked DNA sequences are contiguous and, where necessary to join two protein coding regions, in the same reading frame. Operably linked nucleic acids include a first nucleic acid contiguous with the 5' or 3' end of a second nucleic acid. In other examples, a second nucleic acid is operably linked to a first nucleic acid when it is embedded within the first nucleic acid, for example, where the nucleic acid construct includes (in order) a portion of the first nucleic acid, the second nucleic acid, and the remainder of the first nucleic acid.

Premembrane protein (prM protein): A flavivirus structural protein. The prM protein is an approximately 25 kDa protein that is the intracellular precursor for the membrane (M) protein. prM is believed to stabilize the E protein during transport of the immature virion to the cell surface. When the virus exits the infected cell, the prM protein is cleaved to the mature M protein, which is part of the viral envelope (Reviewed in Lindenbach and Rice, In: *Fields Virology,* Knipe and Howley, eds., Lippincott, Williams, and Wilkins, 991-1041, 2001).

Purified: The term purified does not require absolute purity; rather, it is intended as a relative term. Thus, for example, a purified nucleic acid preparation is one in which the nucleic acid is more enriched than the nucleic acid is in its natural environment (such as within a cell) or in a preparation or production vessel. In other examples, a purified virus preparation is one in which the virus is more enriched than in a cell or organism, a preparation, or a production vessel. A purified nucleic acid or virus also includes one that is substantially free of undesired components, such as an inactivating agent. Preferably, a preparation is purified such that the nucleic acid or virus represents at least 50% of the total content of the preparation. In some embodiments, a purified preparation contains at least 60%, at least 70%, at least 80%, at least 85%, at least 90%, at least 95%, at least 98%, at least 99%, or more of the nucleic acid or virus.

Recombinant nucleic acid: A nucleic acid molecule (or protein or virus) that is not naturally occurring or has a sequence that is made by an artificial combination of two otherwise separated segments of sequence. This artificial combination is accomplished by chemical synthesis or by the artificial manipulation of isolated segments of nucleic acids, e.g., by genetic engineering techniques such as those described in Sambrook et al. (ed.), *Molecular Cloning: A Laboratory Manual,* $2^{nd}$ ed., vol. 1-3, Cold Spring Harbor Laboratory Press, Cold Spring Harbor, NY, 1989. The term recombinant includes nucleic acids and proteins that have been altered solely by addition, substitution, or deletion of a portion of a natural nucleic acid molecule or protein.

Sequence identity: The similarity between two nucleic acid sequences, or two amino acid sequences, is expressed in terms of the similarity between the sequences, otherwise referred to as sequence identity. Sequence identity is frequently measured in terms of percentage identity (or similarity or homology); the higher the percentage, the more similar the two sequences are.

Methods of alignment of sequences for comparison are well known in the art. Various programs and alignment algorithms are described in: Smith and Waterman (*Adv. Appl. Math.,* 2:482, 1981); Needleman and Wunsch (*J. Mol. Biol.,* 48:443, 1970); Pearson and Lipman (*Proc. Natl. Acad. Sci.,* 85:2444, 1988); Higgins and Sharp (Gene, 73:237-44, 1988); Higgins and Sharp (*CABIOS,* 5:151-53, 1989); Corpet et al. (*Nuc. Acids Res.,* 16:10881-90, 1988); Huang et al. (*Comp. Appls. Biosci.,* 8:155-65, 1992); and Pearson et al. (*Meth. Mol. Biol.,* 24:307-31, 1994). Altschul et al. (*Nature Genet.,* 6:119-29, 1994) presents a detailed consideration of sequence alignment methods and homology calculations.

The alignment tools ALIGN (Myers and Miller, *CABIOS* 4:11-17, 1989) or LFASTA (Pearson and Lipman, *Proc. Natl. Acad. Sci.* 85:2444-2448, 1988) may be used to perform sequence comparisons (Internet Program© 1996, W. R. Pearson and the University of Virginia, "fasta20u63" version 2.0u63, release date December 1996). ALIGN compares entire sequences against one another, while LFASTA compares regions of local similarity. These alignment tools and their respective tutorials are available on the Internet at the NCSA website. Alternatively, for comparisons of amino acid sequences of greater than about 30 amino acids, the "Blast 2 sequences" function can be employed using the default BLOSUM62 matrix set to default parameters, (gap existence cost of 11, and a per residue gap cost of 1). When aligning short peptides (fewer than around 30 amino acids), the alignment should be performed using the "Blast 2 sequences" function, employing the PAM30 matrix set to default parameters (open gap 9, extension gap 1 penalties). The BLAST sequence comparison system is available, for instance, from the NCBI web site; see also Altschul et al., *J. Mol. Biol.,* 215:403-10, 1990; Gish and States, *Nature Genet.,* 3:266-72, 1993; Madden et al., *Meth. Enzymol.,* 266:131-41, 1996; Altschul et al., *Nucleic Acids Res.,* 25:3389-402, 1997; and Zhang and Madden, *Genome Res.,* 7:649-56, 1997.

Transformed: A "transformed" cell is a cell into which has been introduced a nucleic acid molecule (such as a heterologous nucleic acid) by molecular biology techniques. The term encompasses all techniques by which a nucleic acid molecule might be introduced into such a cell, including transfection with viral vectors, transformation with plasmid vectors, and introduction of naked DNA by electroporation, lipofection, and particle gun acceleration.

Vector: A vector is a nucleic acid molecule allowing insertion of foreign nucleic acid without disrupting the ability of the vector to replicate and/or integrate in a host cell. A vector can include nucleic acid sequences that permit it to replicate in a host cell, such as an origin of replication. An insertional vector is capable of inserting itself into a host nucleic acid. A vector can also include one or more selectable marker genes and other genetic elements. An expression vector is a vector that contains the necessary regulatory sequences to allow transcription and translation of inserted gene or genes.

West Nile virus (WNV): A member of the virus family Flaviviridae and the genus Flavivirus. Other members of this genus include dengue virus, yellow fever virus, Japanese encephalitis virus (JEV), Zika virus and Spondweni virus. WNV was first isolated from a woman in the West Nile district of Uganda in 1937. The virus was later identified in birds in the Nile delta region in 1953. Human infections attributable to WNV have been reported in many countries for over 50 years. In 1999, a WNV circulating in Israel and Tunisia was imported into New York, producing a large and dramatic outbreak that spread throughout the continental United States in the following years. Human infection is most often the result of bites from infected mosquitoes, but may also be transmitted through contact with other infected animals, their blood or other tissues. Infection with WNV is asymptomatic in about 80% of infected people, but about 20% develop West Nile fever. Symptoms include fever, headache, fatigue, body aches, nausea, vomiting, swollen lymph glands and in some cases, a skin rash. Approximately 1 in 150 of infected individuals develop severe, neuroinvasive disease, such as encephalitis, meningitis or poliomyelitis. Treatment of WNV infection is supportive, such as administration of intravenous fluids, respiratory support and prevention of secondary infections.

Unless otherwise explained, all technical and scientific terms used herein have the same meaning as commonly understood by one of ordinary skill in the art to which this disclosure belongs. The singular terms "a," "an," and "the" include plural referents unless context clearly indicates otherwise. "Comprising A or B" means including A, or B, or A and B. It is further to be understood that all base sizes or amino acid sizes, and all molecular weight or molecular mass values, given for nucleic acids or polypeptides are approximate, and are provided for description. Although methods and materials similar or equivalent to those described herein can be used in the practice or testing of the present disclosure, suitable methods and materials are described below. All publications, patent applications, patents, and other references mentioned herein are incorporated by reference in their entirety. In case of conflict, the present specification, including explanations of terms, will control. In addition, the materials, methods, and examples are illustrative only and not intended to be limiting.

III. Introduction

Dengue virus serology diagnosis, epidemiology serosurveillance, and vaccine research heavily rely upon neutralization tests (NTs), such as plaque and micro-focus reduction neutralization tests (PRNT and mFRNT) to measure DENV-specific neutralizing antibodies that can block virus infection. These NTs can be laborious and require several days to obtain results. To address this problem, described herein are chimeric reporter flaviviruses that are capable of producing strong and rapid fluorescent signals following infection of cells, thereby enabling the development of improved NT for the diagnosis of dengue virus infection. The chimeric reporter viruses (CRVs) express the immunogenic pre-membrane (prM) and envelope (E) proteins of dengue virus (DENV) and a heterologous reporter gene in the highly replicative background of West Nile virus (WNV).

The disclosed chimeric reporter flaviviruses are based on the WN/DENV chimeric viruses disclosed in PCT Publication No. WO 2015/196094, which express the prM and E proteins of a dengue virus (serotype 1, 2, 3 or 4) in the replicative backbone of WNV strain NY99. The resultant virus particles are comprised of the immunogenic DENV antigens (prM and E), but replicate significantly faster than their wild-type DENV counterparts due to presence of the faster growing WNV backbone. PRNT and mFRNT assays are performed twice as fast using the chimeric WN/DENV viruses relative to wild-type DENV.

The present disclosure describes modification of the chimeric WN/DEN viruses to insert a reporter gene in order to develop improved diagnostic assays to detect DENV-specific neutralizing antibodies. The CRVs expressing infectious DENV particles replicate significantly faster than non-chimeric DENV reporter viruses. The reporter (typically a fluorescent protein) expressed in cells following infection provides a highly sensitive signal that can be directly monitored by live-imaging to analyze infectivity. Currently, standard PRNT and mFRNT are time-consuming and labor-intensive, requiring procedures including cell overlay, fixation, plaque staining, and/or immune-staining of viral focus. The live CRVs disclosed herein allow for a real-time, high-throughput neutralization assay without those labor-intensive procedures. Noninfectious reporter virus particles (RVPs) have been developed by others for use in a similarly stain-free neutralization assay. However, the live CRVs disclosed herein are advantageous because they can be produced very easily, can be verified for consistent quality, and can provide a significantly greater signal (through virus replication) for a wider range of applicable assays and experiments that typically rely on infectious viruses (such as mFRNT, whole mosquito infection studies, and mouse studies).

To generate the CRVs (R-WN/DENVs) described herein, a reporter cassette comprised of a reporter gene and a 2A peptide coding sequence was inserted into the capsid (C) gene of the WN/DENV chimeric viruses. The specific insertion site for the reporter cassette was immediately downstream of the coding sequence for the first 35 amino acids of the WNV C protein. The partial C gene provides a critical cyclization sequence connected to the 5' non-coding region for competent virus replication. A complete coding sequence for the WNV C protein immediately followed the 2A site; however, the nucleotide sequence encoding the first 35 amino acids was manually codon edited with silent mutations to minimize homologous recombination potential with the partial C gene located 5' of the reporter cassette (see FIG. 1).

IV. Overview of Several Embodiments

Recombinant chimeric flaviviruses having a reporter gene are described. Chimeric nucleic acid molecules encoding the chimeric flaviviruses are further described. The chimeric flaviviruses include genomic non-coding regions, at least a portion of a C protein and non-structural proteins from a WNV. The prM and E proteins of the chimeric flaviviruses are from a DENV. Diagnostic assays that utilize the disclosed R-WN/DENVs are also described.

In some embodiments disclosed herein, the WNV genome used in the R-WN/DENV is derived from a particular WNV strain, such as NY99 or KEN-3829. Additional WNV strains are known in the art (see, e.g., Ebel et al. *Emerg. Infect. Dis.* 7:650-653, 2001; American Type Culture Collection (ATCC) catalog numbers VR-82, VR-1267, VR-1507, VR-1510). In particular examples, the WNV genome is WN NY99 (GenBank Accession No. AF196835), or a modified WNV as described in Kinney et al. (*J. Gen. Virol.* 87:3611-3622, 2006), U.S. Pat. No. 8,715,689 and/or PCT Publication No. WO 2015/196094, each of which are incorporated by reference herein in their entirety. In some examples, the WNV genome sequence is modified, for example to introduce restriction sites for cloning purposes. These modifications can be silent mutations (for example, nucleotide sequence changes that do not alter amino acid sequence) or they may change the amino acid sequence.

WNV genome sequences are publicly available. For example, GenBank Accession Nos. AF196835, AY278441, AF202541, AF404754, AF260967, AY660002, AF481864, AY268133, AF404757, AY268132, AF260969, AF317203, AY262283, AY490240, AF260968, AY603654, D00246, M12294, EU068667, AY765264, and AY277251 disclose WNV genomic nucleic acid sequences. In further examples, the WNV genome, or the non-coding regions, C protein and/or non-structural proteins of the WNV genome are at least 90%, at least 95%, at least 96%, at least 97%, at least 98%, or at least 99% identical to a publicly available WNV genome sequence.

In some embodiments disclosed herein, the DENV genome is from a DENV serotype 1 (DENV-1), DENV serotype 2 (DENV-2), DENV serotype 3 (DENV-3) or DENV serotype 4 (DENV-4) virus. The DENV genome may be a wild type strain or a recombinant virus. In some examples, the DENV genome is a DENV-1 (for example, wild type DENV-1 strain 16007), DENV-2 (for example, wild type DENV-2 strain 16681), DENV-3 (for example, wild type DENV-3 strain 16562) or DENV-4 (for example, wild type DENV-4 strain 1036) genome. Additional DENV strains are known in the art (see e.g., U.S. Pat. Nos. 5,939,254 and 6,793,488). In some examples, the DENV genome sequence is modified, for example to introduce restriction sites for cloning purposes. These modifications can be silent mutations (for example, nucleotide sequence changes that do not alter amino acid sequence) or they may change the amino acid sequence.

DENV sequences are publicly available. For example GenBank Accession Nos. NC_001477, AF180817, and U88536 disclose DENV-1 nucleic acid sequences; NC_001474 and U87411 disclose DENV-2 nucleic acid sequences; NC_001475, AY099336, and AF317645 disclose DENV-3 nucleic acid sequences; and NC_002640 and AF326825 disclose DENV-4 nucleic acid sequences. In additional examples, the DENV genome (or the prM and/or E protein from the DENV genome) are at least 95%, at least 96%, at least 97%, at least 98%, or at least 99% identical to a publicly available DENV sequence.

The disclosure also provides R-WN/DENV having one or more nucleic acid or amino acid substitutions, insertions, deletions, or combinations thereof. In some instances, the resulting chimera has improved characteristics. In some examples, the improved characteristic of the chimera includes but is not limited to increased virus titer, increased replication rate, increased plaque size, or increased stability in cell culture.

Manipulation of the nucleotide sequence of the disclosed chimeric flaviviruses by standard procedures, including for instance site-directed mutagenesis or PCR and M13 primer mutagenesis, can be used to produce variants with improved characteristics (such as increased virus titer or stability in cell culture). Details of these techniques are well known. For instances, protocols are provided in Sambrook et al. (ed.), Molecular Cloning: A Laboratory Manual, 2nd ed., vol. 1-3, Cold Spring Harbor Laboratory Press, Cold Spring Harbor, NY, 1989. The simplest modifications involve the substitution of one or more amino acids for amino acids having similar physiochemical and/or structural properties. These so-called conservative substitutions are likely to have minimal impact on the activity and/or structure of the resultant protein. Conservative substitutions generally maintain (a) the structure of the polypeptide backbone in the area of the substitution, for example, as a sheet or helical conformation, (b) the charge or hydrophobicity of the molecule at the target site, or (c) the bulk of the side chain. Examples of conservative substitutions are shown below.

| Original Residue | Conservative Substitutions |
|---|---|
| Ala | Ser |
| Arg | Lys |
| Asn | Gln, His |
| Asp | Glu |
| Cys | Ser |
| Gln | Asn |
| Glu | Asp |
| His | Asn; Gln |
| Ile | Leu, Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

The substitutions which in general are expected to produce the greatest changes in protein properties will be non-conservative, for instance changes in which (a) a hydrophilic residue, for example, seryl or threonyl, is substituted for (or by) a hydrophobic residue, for example, leucyl, isoleucyl, phenylalanyl, valyl or alanyl (or vice versa); (b) a cysteine or proline is substituted for (or by) any other residue; (c) a residue having an electropositive side chain, for example, lysyl, arginyl, or histadyl, is substituted for (or by) an electronegative residue, for example, glutamyl or asparty (or vice versa); or (d) a residue having a bulky side chain, for example, phenylalanine, is substituted for (or by) one not having a side chain, for example, glycine (or vice versa).

In addition to targeted mutagenesis to produce variants of the disclosed R-WN/DENVs, mutations may accrue upon passage in cell culture that result in variants, some with desirable characteristics. Nucleic acid and amino acid substitutions, insertions, and/or deletions that accrue in chimeric viruses during cell culture passages are readily determined by sequence analysis of the virus amplified from isolated plaques of the virus seed, and can be engineered into infectious clones to generate R-WN/DENV variants that have improved characteristics (such as replication to high titer). Consistent mutations identified from multiple seeds or isolated plaques are one indication of a desirable substitution of the chimera in the cell type. Previous studies have successfully identified substitutions which occurred in cell culture that can be introduced to produce chimeric viruses with improved characteristics (e.g., Huang et al., *J. Virol.* 77:11436-11447, 2003; Huang et al.,*J. Virol.* 12:7300-7310, 2005; U.S. Pat. No. 8,715,689; and WO 2015/196094, each of which is herein incorporated by reference). Table 8 lists exemplary mutations accrued upon passage of R-WN/DENVs in Vero cells.

In some embodiments herein, the R-WN-DENV-2 includes: an A to G mutation at nucleotide 2422 of SEQ ID NO: 3, resulting in an asparagine to aspartate substitution in the DENV-2 E protein at residue 203; a T to C mutation at nucleotide 307 of SEQ ID NO: 3, resulting in a tyrosine to histidine substitution at residue 36 of ZsGreen; a T to C mutation at nucleotide 4381 of SEQ ID NO: 3, resulting in a phenylalanine to leucine substitution at residue 9 of the WNV NS2A protein; and/or an A to T mutation at nucleotide 4956 of SEQ ID NO: 3, resulting in a silent mutation.

In some embodiments, the R-WN/DENV-3 includes: an A to T mutation at nucleotide 2861 of SEQ ID NO: 5, resulting in a histidine to leucine substitution in the DENV-3 E protein at residues 345; an A to G mutation at nucleotide 253 of SEQ ID NO: 5, resulting in a methionine to valine substitution at residue 18 of ZsGreen; a T to G mutation at nucleotide 1292 of SEQ ID NO: 5, resulting in an isoleucine to serine substitution in the WNV C protein at residue 111; an A to T mutation at nucleotide 2840 of SEQ ID NO: 5, resulting in a glutamine to valine substitution in the DENV-3 E protein at residue 338; an A to T mutation at nucleotide 9420 of SEQ ID NO: 5, resulting in a silent mutation; a C to G mutation at nucleotide 11427 of SEQ ID NO: 5, which is in the 3' non-coding region (NCR); and/or a T to C mutation at nucleotide 11438 of SEQ ID NO: 5, which is in the 3' NCR.

In some embodiments, the R-WN/DENV-4 includes: an A to C mutation at nucleotide 1279 of SEQ ID NO: 9, resulting in a threonine to proline substitution in DENV-4 C protein at residue 100; and/or a C to T mutation at nucleotide 8095 and a T to C mutation at nucleotide 8096 of SEQ ID NO: 9, resulting in a leucine to serine substitution in the WNV NS4B protein at residue 117.

Provided herein are R-WN/DENV nucleic acid molecules comprising in the 5' to 3' direction: a 5' non-coding region from a WNV genome; a nucleic acid encoding amino acid residues 1-35 of a C protein of the WNV; a reporter gene; a nucleic acid encoding a 2A proteolytic site; a nucleic acid encoding a flavivirus C protein; a nucleic acid encoding a prM protein and an E protein from the DENV; a nucleic acid encoding non-structural proteins NS1, NS2A, NS2B, NS3, NS4A, NS4B and NS5 from the WNV; and a 3' non-coding region from the WNV genome.

In some embodiments, the 5' non-coding region comprises nucleotides 1-96 of SEQ ID NO: 1.

In some embodiments, the nucleic acid encoding amino acid residues 1-35 of the C protein comprises nucleotides 97-201 of SEQ ID NO: 1.

In some embodiments, the nucleic acid encoding the complete flavivirus C protein includes a 5' portion encoding amino acid residues 1-35 of a C protein of the WNV, wherein the 5' portion comprises at least one silent mutation; and a 3' portion encoding amino acid residue 36 to the C-terminal most amino acid residue of the flavivirus C protein, wherein the 3' portion comprises a WNV premembrane (prM) signal sequence, a DENV prM signal sequence or a chimeric WNV/DENV prM signal sequence. In some examples, the 3' portion of the nucleic acid encoding the flavivirus C protein encodes amino acid residues 36-123 of the WNV and comprises a WNV prM signal sequence. In other examples, the 3' portion of the nucleic acid encoding the flavivirus C protein encodes amino acid residues 36-105 of the WNV and comprises a DENV prM signal sequence. In yet other examples, wherein the 3' portion of the nucleic acid encoding the flavivirus C protein encodes amino acid residues 36-111 of the WNV and comprises a chimeric WNV/DENV prM signal sequence. In a specific example, the chimeric WNV/DENV prM signal sequence comprises the first six amino acids of the WNV prM signal sequence and the last twelve amino acids of the DENV prM signal sequence.

In some embodiments, the reporter gene encodes a light-emitting protein. In some examples, the light-emitting protein is a fluorescent protein, such as a green, blue, cyan, yellow, orange or red fluorescent protein. In other examples, the light-emitting protein is a bioluminescent protein, such as luciferase. In particular non-limiting examples, the reporter gene encodes a green fluorescent protein, such as ZsGreen or mWasabi. In particular examples, the nucleic acid sequence of the reporter gene (such as ZsGreen) is codon optimized for expression in human cells. In some examples, the reporter gene comprises nucleotides 202-894 of SEQ ID NO: 1 or nucleotide 202-894 of SEQ ID NO: 11.

In some embodiments, the 2A proteolytic site is from porcine teschovirus (PTV) or foot and mouth disease virus (FMDV). In some examples, the nucleic acid encoding the 2A proteolytic site is at least 95%, at least 96%, at least 97% at least 98% or at least 99% identical to nucleotides 895-960 of SEQ ID NO: 1. In particular examples, the nucleic acid encoding the 2A proteolytic site comprises the sequence of nucleotides 895-960 of SEQ ID NO: 1.

In some embodiments, the 5' portion of the nucleic acid encoding the complete flavivirus C protein connected downstream of the 2A comprises at least 5, at least 10, at least 15, at least 20, at least 25 or at least 30 silent mutations. In specific examples, the 5' portion of the nucleic acid encoding the flavivirus C protein comprises 1, 2 3, 4, 5, 6, 7, 8, 9, 10, 11, 12, 13, 14, 15 16, 17, 18, 19, 20, 21, 22, 23, 24, 25, 26, 27, 28, 29, 30, 31, 32, 33, 34 or 35 silent mutations. In specific non-limiting examples, the 5' portion of the nucleic acid encoding the flavivirus C protein is at least 90%, at least 91%, at least 92%, at least 93%, at least 94%, at least 95%, at least 96%, at least 97%, at least 98% or at least 99% identical to nucleotides 961-1065 of SEQ ID NO: 1, or comprises the sequence of nucleotides 961-1065 of SEQ ID NO: 1.

In some embodiments, one or more of the non-structural proteins are encoded by the sequences listed in any of Tables 1-6.

In some embodiments, the 3' non-coding region comprises nucleotides 11227-11860 of SEQ ID NO: 1.

In some embodiments, the WNV is strain NY99.

In some embodiments, the DENV is a DENV-1, such as, but not limited to strain 16007. In some examples, the chimeric flavivirus nucleic acid molecule is at least 90%, at least 91%, at least 92%, at least 93%, at least 94%, at least 95%, at least 96%, at least 97%, at least 98% or at least 99% identical to SEQ ID NO: 1. In particular examples, the chimeric flavivirus nucleic acid molecule comprises SEQ ID NO: 1.

In some embodiments, the DENV is a DENV-2, such as, but not limited to strain 16681. In some examples, the chimeric flavivirus nucleic acid molecule is at least 90%, at least 91%, at least 92%, at least 93%, at least 94%, at least 95%, at least 96%, at least 97%, at least 98% or at least 99% identical to SEQ ID NO: 3 or SEQ ID NO: 28. In particular examples, the chimeric flavivirus nucleic acid molecule comprises SEQ ID NO: 3 or SEQ ID NO: 28.

In some embodiments, the DENV is a DENV-3, such as, but not limited to strain 16562. In some examples, the chimeric flavivirus nucleic acid molecule is at least 90%, at least 91%, at least 92%, at least 93%, at least 94%, at least 95%, at least 96%, at least 97%, at least 98% or at least 99% identical to SEQ ID NO: 5, SEQ ID NO: 7 or SEQ ID NO: 30. In particular examples, the chimeric flavivirus nucleic acid molecule comprises SEQ ID NO: 5, SEQ ID NO: 7 or SEQ ID NO: 30.

In some embodiments, the DENV is a DENV-4, such as, but not limited to strain 1036. In some examples, the chimeric flavivirus nucleic acid molecule is at least 90%, at least 91%, at least 92%, at least 93%, at least 94%, at least 95%, at least 96%, at least 97%, at least 98% or at least 99% identical to SEQ ID NO: 9, SEQ ID NO: 11 or SEQ ID NO:

32. In particular examples, the chimeric flavivirus nucleic acid molecule comprises SEQ ID NO: 9, SEQ ID NO: 11 or SEQ ID NO: 32.

Further provided are recombinant virus comprising a chimeric flavivirus nucleic acid molecule disclosed herein.

Also provided are kits that include a chimeric flavivirus nucleic acid molecule or a recombinant virus disclosed herein. In some embodiments, the kits further include cultured cells, cell culture media and/or instructions.

Further provided is a method of detecting dengue virus-specific antibodies in a biological sample. In some embodiments, the method includes contacting the sample with a CRV disclosed herein to form a virus-sample mixture, wherein virus-antibody complexes are formed in the virus-sample mixture if dengue virus-specific antibodies are present in the sample; inoculating a cell culture with the virus-sample mixture under conditions sufficient to allow infection of the cell culture by any virus not successfully neutralized by the sample and subsequent expression of the reporter gene in infected cells; and detecting a decrease in expression of the reporter gene in the cell culture as compared to a cell culture inoculated with the CRV alone or CRV contacted with a negative control sample (sample without DENV-neutralizing Ab). In some examples, the biological sample includes blood or serum.

V. Preparation of Chimeric Reporter Viruses (CRVs)

The CRVs containing the disclosed nucleic acid chimeras can readily be produced by replication in host cells in culture. Methods of producing viruses are well known in the art (see e.g. *Fields Virology*, Knipe and Howley, eds., Lippincott, Williams, and Wilkins, 2001; Flint et al., *Principles of Virology*, ASM Press, 2000). Host cell lines are generally selected to be easy to infect with virus or transfect with viral genomic RNA, capable of stably maintaining foreign RNA with an unarranged sequence, and have the necessary cellular components for efficient transcription, translation, post-translation modification, virus assembly, and secretion of the protein or virus particle. In addition, cells are typically those having simple media component requirements which can be adapted for growth in suspension culture. In some examples, the host cell line is a mammalian or mosquito cell line that is adapted to growth in low serum or serum-free medium. Exemplary suitable host cell lines include Vero (monkey), C6/36 (mosquito), BHK21 (hamster), LLC-MK2 (monkey) SK6 (swine), L292 (mouse), HeLa (human), HEK (human), 2fTGH cells (human), HepG2 (human), and PDK (dog) cells. Suitable cell lines can be obtained from the American Type Culture Collection (ATCC), Manassas, Va. Methods of cell culture, viral replication, plaque titration, and virus or virus particle purification are well known in the art. See e.g. Obijeski et al., J. *Gen. Virol.* 22:21-33, 1974; Beaty et al., *Diagnostic Procedures for Viral, Ricksettial, and Chlamydial Infections,* pp. 189-212, Lennette et al. (eds.), 7$^{th}$ Edition, American Public Health Association, 1995; *Virology Methods Manual,* Mahy and Kangro (eds.), Academic Press, 1996.

The CRVs of the present disclosure can be made using standard methods known and recognized in the art. For example, an RNA molecule corresponding to the genome of a chimeric virus can be introduced into primary cells, chick embryos, or diploid cell lines, from which (or the supernatants of which) progeny virus can then be purified. Another method that can be used to produce the viruses employs heteroploid cells, such as Vero cells (Yasumura et al., *Nihon Rinsho* 21:1201-1215, 1963) or C6/36 cells. In this method, a nucleic acid molecule (e.g., an RNA molecule) corresponding to the genome of a chimeric virus is introduced into the heteroploid cells and virus is harvested from the medium in which the cells have been cultured. The harvested virus can be further amplified in cell cultures and then concentrated (e.g., by PEG 8000 precipitation, use of ultrafiltration, such as a filter having a molecular weight cut-off of, e.g., 50-500 kDa (e.g., Amicon ultracentrifugal filter, tangential flow filtration cassette, or Pellicon-2 Mini ultrafilter cassette)), diafiltered against cell medium without phenol red or PBS, formulated by the addition of lactose, fetal bovine serum, or other suitable cryopreserve reagent, and filtered into a sterile container. Details of a method of virus production are provided in PCT Publication No. WO 03/060088, which is incorporated herein by reference. Viruses optionally are further purified, for example by density gradient centrifugation, glycerol cushion centrifugation, and/or Cellufine® sulfate media chromatography. The virus product can be made into desirable aliquots and stored in freezer below −65° C. for years without losing infectivity.

The following examples are provided to illustrate certain particular features and/or embodiments. These examples should not be construed to limit the disclosure to the particular features or embodiments described.

EXAMPLES

Example 1

Engineering of Reporter-WN/DENV (R-WN/DENV) Constructs

This example describes the construction of CRVs that express DENV-1, -2, -3 or -4 prM/E proteins in the replicative background of West Nile virus strain NY99. The CRVs include a reporter gene that allows for easy detection of infected cells in dengue virus neutralization assays.

A reporter cassette that includes fluorescent reporter gene ZsGreen and a sequence encoding the porcine teschovirus 2A (P2A) self-cleaving peptide was inserted into chimeric WN/DENV virus constructs to generate live chimeric R-WN/DENVs. As shown in FIG. 1, three different C/prM junction site strategies were used in previously constructed WN/DENVs without reporter (see U.S. Pat. No. 8,715,689 and WO 2015/196094, which are incorporated by reference herein). In Type I constructs, the prM signal sequence is derived from DENV, while in Type III constructs, the prM signal sequence is derived from WNV. The prM signal sequence of Type II constructs contains sequence from both DENV and WNV. In each construct, the reporter cassette was inserted 5' of a complete C gene. A partial C gene encoding the first 35 amino acids was added 5' of the reporter cassette. The partial C gene provides a critical cyclization sequence connected to the 5' non-coding region for competent virus replication. The first 35 amino acids in the complete C gene ($C_{ed}$) was codon edited with silent mutations to minimize homologous recombination potential with the partial C gene (see FIG. 2).

Using the Type I strategy, live chimeric viruses were successfully generated for R-WN/DENV-1, R-WN/DENV-2 and R-WN/DENV-4 (see Tables 1, 2, 5 and 6). Two R-WN/DENV-4 constructs were generated—one with wild-type ZsGreen (Table 5) and a second with a codon-optimized ZsGreen (referred to as ZsGreen1 in Table 6). WN/DENV-3 constructs were made using Type II (Table 3) and Type III strategies (Table 4). The nucleotide and amino acid sequences of the reporter viruses are set forth herein as SEQ ID NOs: 1-12 and 28-33, and relevant nucleotide and amino acid positions are noted in Tables 1-6 and 8.

All of the CRV constructs contain some mutations that were previously engineered into the WN/DENV constructs. Most of the engineered mutations are silent mutations for restriction enzyme site removal or incorporation for cloning. However, one amino acid change from Thr to Ser at the WNV NS1-2 was present in all CRV constructs resulting from a DENV E/WNV NS1 junction cloning site. In addition, one Vero cell-adapted mutation each made in WN/DENV-2 (E-203 N to D), WN/DENV-3 BE345 and CE345 (E-345 H to L), and WN/DENV-4 (C-107 T to P) was also included in the CRV construct based on the chimera clones.

TABLE 1

R-WN/DENV-1

| Genetic structure | | | | |
|---|---|---|---|---|
| Gene | Range[a] | nt position[b] | AA position[c] | Source of gene virus (nt/AA) |
| 5'NCR | | 1-96 | — | WNV (1-96/—) |
| Partial-C | 1-35 | 97-201 | 1-35 | WNV (97-201/1-35) |
| ZsGreen | 1-231 | 202-894 | 36-266 | *Zoanthus* sp. reef coral |
| P2A | 1-22 | 895-960 | 267-288 | Porcine Teschovirus-1 |
| C | 1-35 (codon edit) | 961-1065 | 289-323 | WNV (97-201edit/1-35) |
| | 36-105 | 1066-1275 | 324-393 | WNV (202-411/36-105) |
| | 106-119 | 1276-1317 | 394-407 | DENV-1 (395-436/101-114) |
| prM | 1-166 | 1318-1815 | 408-573 | DENV-1 (437-934/115-280) |
| E | 1-495 | 1816-3300 | 574-1068 | DENV-1 (935-2419/281-775) |
| NS1 | 1-352 | 3301-4356 | 1069-1420 | WNV (2470-3525/792-1143) |
| NS2A | 1-231 | 4357-5049 | 1421-1651 | WNV (3526-4218/1144-1374) |
| NS2B | 1-131 | 5050-5442 | 1652-1782 | WNV (4219-4611/1375-1505) |
| NS3 | 1-619 | 5443-7299 | 1783-2401 | WNV (4612-6468/1506-2124) |
| NS4A | 1-149 | 7300-7746 | 2402-2550 | WNV (6469-6915/2125-2273) |
| NS4B | 1-255 | 7747-8511 | 2551-2805 | WNV (6916-7680/2274-2528) |
| NS5 | 1-905 | 8512-11226 | 2806-3710 | WNV (7681-10395/2529-3433) |
| 3' NCR | | 11227-11860 | — | WNV (10396-11029/—) |

[a]Numbers = amino acid position of each gene
[b]Nucleotide position based on full genome (SEQ ID NO: 1)
[c]Amino acid position based on polyprotein (SEQ ID NO: 2)

TABLE 2

R-WN/DENV-2

| Genetic structure | | | | |
|---|---|---|---|---|
| Gene | Range[a] | nt position[b] | AA position[c] | Source of gene virus (nt/AA) |
| 5'NCR | | 1-96 | — | WNV (1-96/—) |
| Partial-C | 1-35 | 97-201 | 1-35 | WNV (97-201/1-35) |
| ZsGreen | 1-231 | 202-894 | 36-266 | *Zoanthus* sp. reef coral |
| P2A | 1-22 | 895-960 | 267-288 | Porcine Teschovirus-1 |
| C | 1-35 (codon edit) | 961-1065 | 289-323 | WNV (97-201edit/1-35) |
| | 36-105 | 1066-1275 | 324-393 | WNV (202-411/36-105) |
| | 106-119 | 1276-1317 | 394-407 | DENV-2 (395-436/101-114) |
| prM | 1-166 | 1318-1815 | 408-573 | DENV-2 (437-934/115-280) |
| E | 1-495 | 1816-3300 | 574-1068 | DENV-2 (935-2419/281-775) |
| NS1 | 1-352 | 3301-4356 | 1069-1420 | WNV (2470-3525/792-1143) |
| NS2A | 1-231 | 4357-5049 | 1421-1651 | WNV (3526-4218/1144-1374) |
| NS2B | 1-131 | 5050-5442 | 1652-1782 | WNV (4219-4611/1375-1505) |
| NS3 | 1-619 | 5443-7299 | 1783-2401 | WNV (4612-6468/1506-2124) |
| NS4A | 1-149 | 7300-7746 | 2402-2550 | WNV (6469-6915/2125-2273) |
| NS4B | 1-255 | 7747-8511 | 2551-2805 | WNV (6916-7680/2274-2528) |
| NS5 | 1-905 | 8512-11226 | 2806-3710 | WNV (7681-10395/2529-3433) |
| 3' NCR | | 11227-11860 | — | WNV (10396-11029/—) |

[a]Numbers = amino acid position of each gene
[b]Nucleotide position based on full genome (SEQ ID NOs: 3 or 28)
[c]Amino acid position based on polyprotein (SEQ ID NOs: 4 or 29)

TABLE 3

R-WN/DENV-3 BE 345

Genetic structure

| Gene | Range[a] | nt position[b] | AA position[c] | Source of gene virus (nt/AA) |
|---|---|---|---|---|
| 5'NCR | | 1-96 | — | WNV (1-96/—) |
| Partial-C | 1-35 | 97-201 | 1-35 | WNV (97-201/1-35) |
| ZsGreen | 1-231 | 202-894 | 36-266 | *Zoanthus* sp. reef coral |
| P2A | 1-22 | 895-960 | 267-288 | Porcine Teschovirus-1 |
| C | 1-35 (codon edit) | 961-1065 | 289-323 | WNV (97-201edit/1-35) |
| | 36-111 | 1066-1293 | 324-399 | WNV (202-429/36-111) |
| | 112-123 | 1294-1329 | 394-411 | DENV-3 (401-436/101-114) |
| prM | 1-166 | 1330-1827 | 408-577 | DENV-3 (437-934/115-280) |
| E | 1-493 | 1828-3306 | 578-1070 | DENV-3 (935-2413/281-773) |
| NS1 | 1-352 | 3307-4362 | 1071-1422 | WNV (2470-3525/792-1143) |
| NS2A | 1-231 | 4363-5055 | 1423-1653 | WNV (3526-4218/1144-1374) |
| NS2B | 1-131 | 5056-5448 | 1654-1784 | WNV (4219-4611/1375-1505) |
| NS3 | 1-619 | 5449-7305 | 1785-2403 | WNV (4612-6468/1506-2124) |
| NS4A | 1-149 | 7306-7752 | 2404-2552 | WNV (6469-6915/2125-2273) |
| NS4B | 1-255 | 7753-8517 | 2553-2807 | WNV (6916-7680/2274-2528) |
| NS5 | 1-905 | 8518-11232 | 2808-3712 | WNV (7681-10395/2529-3433) |
| 3' NCR | | 11233-11866 | — | WNV (10396-11029/—) |

[a]Numbers = amino acid position of each gene
[b]Nucleotide position based on full genome (SEQ ID NOs: 5 or 30)
[c]Amino acid position based on polyprotein (SEQ ID NOs: 6 or 31)

TABLE 4

R-WN/DENV-3 CE 345

Genetic structure

| Gene | Range[a] | nt position[b] | AA position[c] | Source of gene virus (nt/AA) |
|---|---|---|---|---|
| 5'NCR | | 1-96 | — | WNV (1-96/—) |
| Partial-C | 1-35 | 97-201 | 1-35 | WNV (97-201/1-35) |
| ZsGreen | 1-231 | 202-894 | 36-266 | *Zoanthus* sp. reef coral |
| P2A | 1-22 | 895-960 | 267-288 | Porcine Teschovirus-1 |
| C | 1-35 (codon edit) | 961-1065 | 289-323 | WNV (97-201edit/1-35) |
| | 36-123 | 1066-1329 | 324-411 | WNV (202-465/36-123) |
| prM | 1-166 | 1330-1827 | 408-577 | DENV-3 (437-934/115-280) |
| E | 1-493 | 1828-3306 | 578-1070 | DENV-3 (935-2413/281-773) |
| NS1 | 1-352 | 3307-4362 | 1071-1422 | WNV (2470-3525/792-1143) |
| NS2A | 1-231 | 4363-5055 | 1423-1653 | WNV (3526-4218/1144-1374) |
| NS2B | 1-131 | 5056-5448 | 1654-1784 | WNV (4219-4611/1375-1505) |
| NS3 | 1-619 | 5449-7305 | 1785-2403 | WNV (4612-6468/1506-2124) |
| NS4A | 1-149 | 7306-7752 | 2404-2552 | WNV (6469-6915/2125-2273) |
| NS4B | 1-255 | 7753-8517 | 2553-2807 | WNV (6916-7680/2274-2528) |
| NS5 | 1-905 | 8518-11232 | 2808-3712 | WNV (7681-10395/2529-3433) |
| 3' NCR | | 11233-11866 | — | WNV (10396-11029/—) |

[a]Numbers = amino acid position of each gene
[b]Nucleotide position based on full genome (SEQ ID NO: 7)
[c]Amino acid position based on polyprotein (SEQ ID NO: 8)

TABLE 5

R-WN/DENV-4

Genetic structure

| Gene | Range[a] | nt position[b] | AA position[c] | Source of gene virus (nt/AA) |
|---|---|---|---|---|
| 5'NCR | | 1-96 | — | WNV (1-96/—) |
| Partial-C | 1-35 | 97-201 | 1-35 | WNV (97-201/1-35) |
| ZsGreen | 1-231 | 202-894 | 36-266 | *Zoanthus* sp. reef coral |

TABLE 5-continued

| R-WN/DENV-4 | | | | |
|---|---|---|---|---|
| Genetic structure | | | | |
| Gene | Range[a] | nt position[b] | AA position[c] | Source of gene virus (nt/AA) |
| P2A | 1-22 | 895-960 | 267-288 | Porcine Teschovirus-1 |
| C | 1-35 (codon edit) | 961-1065 | 289-323 | WNV (97-201edit/1-35) |
| | 36-105 | 1066-1275 | 324-393 | WNV (202-411/36-105) |
| | 106-119 | 1276-1317 | 394-407 | DENV-4 (399-440/100-113) |
| prM | 1-166 | 1318-1815 | 408-573 | DENV-4 (441-938/114-279) |
| E | 1-495 | 1816-3300 | 574-1068 | DENV-4 (939-2423/280-774) |
| NS1 | 1-352 | 3301-4356 | 1069-1420 | WNV (2470-3525/792-1143) |
| NS2A | 1-231 | 4357-5049 | 1421-1651 | WNV (3526-4218/1144-1374) |
| NS2B | 1-131 | 5050-5442 | 1652-1782 | WNV (4219-4611/1375-1505) |
| NS3 | 1-619 | 5443-7299 | 1783-2401 | WNV (4612-6468/1506-2124) |
| NS4A | 1-149 | 7300-7746 | 2402-2550 | WNV (6469-6915/2125-2273) |
| NS4B | 1-255 | 7747-8511 | 2551-2805 | WNV (6916-7680/2274-2528) |
| NS5 | 1-905 | 8512-11226 | 2806-3710 | WNV (7681-10395/2529-3433) |
| 3' NCR | | 11227-11860 | — | WNV (10396-11029/—) |

[a]Numbers = amino acid position of each gene
[b]Nucleotide position based on full genome (SEQ ID NOs: 9 or 32)
[c]Amino acid position based on polyprotein (SEQ ID NOs: 10 or 33)

TABLE 6

| R-WN/DENV-4 CO | | | | |
|---|---|---|---|---|
| Genetic structure | | | | |
| Gene | Range[a] | nt position[b] | AA position[c] | Source of gene virus (nt/AA) |
| 5'NCR | | 1-96 | — | WNV (1-96/—) |
| Partial-C | 1-35 | 97-201 | 1-35 | WNV (97-201/1-35) |
| ZsGreen1 | 1-231 (codon optimized) | 202-894 | 36-266 | *Zoanthus* sp. reef coral |
| P2A | 1-22 | 895-960 | 267-288 | Porcine Teschovirus-1 |
| C | 1-35 (codon optimized) | 961-1065 | 289-323 | WNV (97-201/1-35) |
| | 36-105 | 1066-1275 | 324-393 | WNV (202-411/36-105) |
| | 106-119 | 1276-1317 | 394-407 | DENV-4 (399-440/100-113) |
| prM | 1-166 | 1318-1815 | 408-573 | DENV-4 (441-938/114-279) |
| E | 1-495 | 1816-3300 | 574-1068 | DENV-4 (939-2423/280-774) |
| NS1 | 1-352 | 3301-4356 | 1069-1420 | WNV (2470-3525/792-1143) |
| NS2A | 1-231 | 4357-5049 | 1421-1651 | WNV (3526-4218/1144-1374) |
| NS2B | 1-131 | 5050-5442 | 1652-1782 | WNV (4219-4611/1375-1505) |
| NS3 | 1-619 | 5443-7299 | 1783-2401 | WNV (4612-6468/1506-2124) |
| NS4A | 1-149 | 7300-7746 | 2402-2550 | WNV (6469-6915/2125-2273) |
| NS4B | 1-255 | 7747-8511 | 2551-2805 | WNV (6916-7680/2274-2528) |
| NS5 | 1-905 | 8512-11226 | 2806-3710 | WNV (7681-10395/2529-3433) |
| 3' NCR | | 11227-11860 | — | WNV (10396-11029/—) |

[a]Numbers = amino acid position of each gene
[b]Nucleotide position based on full genome (SEQ ID NO: 11)
[c]Amino acid position based on polyprotein (SEQ ID NO: 12)

Example 2

Production and Quality Control of R-WN/DENV Seeds

All R-WN/DENVs were first generated from C6/36 cells transfected by in vitro transcribed RNA made from R-WN/DENV cDNA constructs (FIG. 2). The recovered live R-WN/DENVs WN/DENVs from transfected cell culture (designated as C6-0 transfection seed stock) were further amplified once (C6-1) or twice (C6-2) in C6/36 cells to generate the master seed (MS) stocks (FIG. 3). The full genome sequence of each MS lot was verified by consensus sequencing, and seed lots with expected genomic sequence were used to produce working seed (WS) stocks that were used for experiments. Based on a laboratory-scale production scheme (FIG. 3), the WS stocks were passaged in cell cultures only 3-4 times (including transfection cell culture as first passage). This low cell passage strategy was designed to minimized genetic variations of each WS lots. Since all R-WN/DENVVs replicated to very high titers in C6/36 cells (typically 8-9 $\log_{10}$ ffu/ml; ffu =fluorescent foci unit), it was estimated that this laboratory-scale production plan would produce at least 50,000 L total of WS lots to support more than $5\times10^9$ of 96-well plates for the reporter-virus-based mFRNT (R-mFRNT). This estimation was based on a single T75 flask of transfection seed lot (30 ml). It was assumed that only 20-33% of each seed lot (C6-0 to C6-2) would be used to amplify the next seed stock (infected cells at a MOI of 0.1) until reaching the C6-3 WS stocks. The following is a brief description of the calculation:

1. A single T75 flask of C6-0 transfection seed (~30 ml) generates sufficient R-WN/DENV (assumed titer at $5\times10^7$ ffu/ml, total $1.5\times10^9$ ffu) to infect more than 500×T150 flasks (about 50 ml culture/T150 flask) at MOI of 0.1 (about $5\times10^6$ ffu/flask of $5\times10^7$ cells) to make the C6-1 seed.
2. If only 100 out of the 500 flasks (20%) of C6-1 seed were actually made: These 100 flasks (produced in separate lots) of C6-1 seed can generate at least 10,000×T150 flasks of the C6-2 lots (used as MS in this estimation).
3. If only 20% of the C6-2 MS lots (2,000 of the 10,000 flasks) are used for WS production: The MS lots can generate about 1 million×T150 flasks (50,000,000 mL of $>5\times10^7$ ffu/ml virus; total $\sim5\times10^{14}$ ffu) of WS. For the high throughput R-mFRNT, a single 96-well plate assay requires less than $1\times10^5$ ffu of the WS stock. Therefore, the estimated WS amount can support up to $5\times10^9$ of 96-well of plates.

Many fluorescent reporter genes have been found to lack stability in flavivirus genome constructs. A portion of such unstable reporter virus stocks generated from multiple rounds of cell culture amplification may contain fully or partially deleted reporter gene, and cannot be used in experiments that require correct measurement of CRV infectivity by the reporter signal. To verify the ZsGreen stability in the CRVS, an RT-PCR assay was developed that amplifies the entire length of the ZsGreen gene to monitor gene integrity from each R-WN/DENV stock. In addition, a dual-color flow cytometry assay was used to measure virus-infected cells (detecting viral antigen by a monoclonal antibody to WNV C protein) that co-express ZsGreen proteins. Only the R-WN/DENV stocks that have been confirmed with full-length ZsGreen integrity by RT-PCR and have shown close to 100% of ZsGreen and viral protein co-expression in their infected cells were used for experiments (FIG. 3).

R-WN/DENV-1:

Live R-WN/DENV-1 (Table 1, SEQ ID NOs: 1 and 2) was successfully derived after C6/36 cell transfection, and it replicated robustly in both C6/36 cells (>7-9 $\log_{10}$ pfu/ml) and Vero cells (>6-7 $\log_{10}$ pfu/ml). Other than the previously engineered mutations in WN/DENV-1, no other mutation was identified in the genome of the R-WN/DENV-1 MS. The ZsGreen gene was stable in both MS and WS. RT/PCR and dual-color flow cytometry assay indicated that ZsGreen was stable for at least 6 passages in C6/36 cells (C6-0 to C6-5) and at least 5 times in Vero cells (Table 7). As indicated above, the production plan only requires 3-4 cell culture passages to generate WS stocks for experiment, thereby the R-WN/DENV-1 construct is deemed sufficiently stable for the R-mFRNT (Example 3 and Table 10).

R-WN/DENV-2

R-WN/DENV-2 (Table 2, SEQ ID NOs: 3 and 4) contains a DENV-2 E203 (N to D) mutation that was previously incorporated in the chimeric WN/DENV-2 E203 (U.S. Pat. No. 8,715,689; and Tables 7 and 8) to enhance the stability of the chimeric virus in Vero cells. Serial cell passage of the R-WN/DENV-2 revealed that it was stable up to 4 times in C6/36 cells, but only 1 passage in Vero cells (Table 7). The C6-1, -2, and -3 seed stocks are appropriate for use in R-mFRNT that measures only first round of virus infection in Vero cells. Therefore, these seeds have been used to develop and evaluate the R-mFRNT with a panel of human specimen (Example 3 Table 10).

To ensure stable R-WN/DENV-2 seed stocks can be consistently generated from cell cultures (especially in Vero cells) and to expand potential usefulness of the CRV for other experiments that may require multiple virus infection rounds, potential Vero-adapted mutations that may enhance the ZsGreen stability in the R-WN/DENV-2 construct were investigated. Plaque purification and serial Vero cell passages were conducted of the R-WN/DENV-2 C6-4 seed to select an isolate with stable ZsGreen in Vero cells. Six isolated viral plaques with strong ZsGreen signal were picked (named as plaque pick-1 to -6 or PP1-6) from Vero cell plates. Each PP was serially passaged in Vero cells and monitored for the reporter integrity by RT-PCR, flow cytometry, and florescent microscope. The PP4 isolate (R-WN/DENV-2 PP4; SEQ ID NO: 28) had the highest Vero cell ZsGreen stability (up to 5 passages, and only a very small portion of the virus harvested from the $6^{th}$ Vero cell passages had a partially deleted ZsGreen gene (Table 7). Sequencing of the PP4Vero-4 seed revealed 3 mutations at ZsGreen-36, WNV NS2A-9, and WN NS2A-200 (Table 8). Incorporating one or more of these mutations into the R-WN/DENV-2 cDNA construct may result in a new R-WN/DENV-2 construct with improved reporter gene stability in Vero cells. MS and WS stocks of the R-WN/DENV-2 PP4 containing all 3 mutations were also generated for use in R-mFRNT (Example 3).

R-WN/DENV-3

Two R-WN/DENV-3 constructs, R-WN/DENV-3 BE345 (Table 3, SEQ ID NOs: 5 and 6) and CE345 (Table 4, SEQ ID NOs: 7 and 8) were made based on previous chimeric WN/DENV-3 BE345 and CE345 (Tables 7 and 8; and WO 2015/196094). Both constructs include a DENV-3 E345 (H-to-L) mutation that was originally cloned into the WN/DENV-3 chimeras for Vero cell stabilization (as described in WO 2015/196094). The ZsGreen reporter in both constructs was only stable in the C6-0 transfection seed (Table 7 and FIG. 4). To identify potential cell-adapted mutations for ZsGreen stability in the constructs, plaque pick isolation was conducted from Vero cell plates infected with the R-WN/DENV-3 BE345 C6-0 transfection seed. Similar to the PP isolation described above in R-WN/DENV-2, multiple R-WN/DENV-3 BE345 plaques with strong ZsGreen signal were picked, and each PP isolate was serially passaged in both C6/36 and Vero cells.

Among the PPs, PP4 of the R-WN/DENV (SEQ ID NO: 30) appeared to be the most stable (at least 5 times in C6/36 cells, and at least 4 passages in Vero cells; Table 7 and FIG. 4). Sequencing of the PP4/C6-2/Vero-4 stock showed 6 mutations, including 3 amino acid mutations (ZsGreen-18, WNV C-111, DENV-3 E-338), a silent mutation, and 2 WNV 3' non-coding region (3' NCR) mutations (Table 8). Before obtaining a new R-WN/DENV-3 construct with one or more of these mutations, a WS stock was made from the R-WN/DENV-3 BE345 PP4/C6-2/V-3 that was verified with 100% ZsGreen integrity and it was used for the R-mFRNT evaluation (Example 3).

One or more cell-adapted mutations identified from the R-WN/DENV-3 BE345 PP4/C6-2/Vero-4 seed may also be effective for stabilizing ZsGreen in R-WN/DENV CE345.

R-WN/DENV-4

R-WN/DENV-4 (Table 5, SEQ ID NOs: 9 and 10) and R-WN/DENV-4 CO (Table 6, SEQ ID NOs: 11 and 12) were both based on the chimeric WN/DENV-4 C107 genetic backbone that contains a mutation at C107 (T-to-P) for Vero cell adaption (Tables 7 and 8; see also WO 2015/196094). The R-WN/DENV-4 with wt ZsGreen gene insertion appeared to be more stable than the R-WN/DENV-4 CO that contains human codon-optimized ZsGreen insertion, and therefore only the R-WN/DENV-4 was selected for further development.

R-WN/DENV-4 was stable for at least 4 passages in C6/36 cells, but only 2 passages in Vero cells (Table 7). Using a similar plaque purification and serial Vero cell passage strategy as described above, a PP1 isolate that was stable in Vero cells for at least 5 passages was obtained (Table 7). Two adjacent nucleotide mutations resulting in a single WNV NS4B-117 amino acid substitution were identified from the C6-2/PP1/Vero-3 seed (Table 8; SEQ ID NO: 32). For the R-mFRNT evaluation, stability of the original R-WN/DENV-4 was adequate to produce stable WS which was used successfully for the assay (Example 3). The NS4B-117 mutation and/or more cell-evolved mutation may be engineered into the R-WN/DENV-4 construct to obtain CRV with higher ZsGreen stability in cells.

TABLE 7

Stability of ZsGreen of the CRV cultured in C6/36 or Vero cells

| CRV name | Stable passage numbers C6/36 | Vero |
|---|---|---|
| R-WN/DENV-1 | ≥6 | ≥5 |
| R-WN/DENV-2 | 1-4 | 1 |
| R-WN/DENV-2 C6-4/PP4 | ≥4 | 5 |
| R-WN/DENV-3 BE345 | 1 | 0 |
| R-WN/DENV-3 BE345 C6-0/PP4 | ≥5 | ≥4 |
| R-WN/DENV-3 CE345 | 1 | ND |
| R-WN/DENV-4 | 4 | 2 |
| R-WN/DENV-4 C6-2/PP1 | ≥4 | ≥5 |

ND = not determined

TABLE 8

Evolved mutations identified from plaque isolate passaged multiple times in cells

| CRV name and passages*** | Nucleotide position based on R-WN/DENV | WNV | DENV | AA position | Mutation |
|---|---|---|---|---|---|
| R-WN/DENV-2 | 2422 | N/A | DENV2-1543 | DV2 E-203* | A--> G (Asn to Asp) |
| C6-4/PP4/Vero-4 | 307 | N/A | N/A | ZsGreen-36 | T --> C (Tyr to His) |
| (SEQ ID NO: 28) | 4381 | 3550 | N/A | WNV NS2A-9 | T --> C (Phe to Leu) |
| | 4956 | 4125 | N/A | WNV NS2A-200 | A --> T (silent) |
| | 2861 | N/A | DENV3-1968 | DV3 E-345* | A --> T (His to Leu) |
| R-WN/DENV-3 | 253 | N/A | N/A | ZsGreen-18 | A --> G (Met to Val) |
| BE345 | 1292 | 428 | N/A | WNVC-111 | T --> G (Ile to Ser) |
| C6-0/PP4/C6- | 2840 | N/A | 1947 | DV3 E-338 | A --> T (Glu to Val) |
| 2/Vero-4 | 9420 | 8583 | N/A | WNVNS5-301 | A --> T (silent) |
| (SEQ ID NO: 30) | 11427 | 10590 | N/A | 3' NCR | C --> G |
| | 11438 | 10601 | N/A | 3' NCR | T --> C |
| R-WN/DENV-4 | 1279 | N/A | DENV4-401 | DV-4 C-100** | A --> C (Thr to Pro) |
| C6-2/PP1/Vero-3 | 8095 | 7264 | N/A | NS4B-117 | C --> T (Leu to Ser) |
| (SEQ ID NO: 32) | 8096 | 7265 | N/A | NS4B-117 | T --> C (Leu to Ser) |

*Engineered mutation presented in the previous engineered chimeric WN/DENV (without reporter) for cell adaption.
**The AA position based on the R-WN/DENV-4 would be C107
***The polyprotein sequences of R-WN/DENV-2 PP4, R-WN/DENV03 PP4 and R-WN/DENV-4 PP1 are provided as SEQ ID NO: 29, SEQ ID NO: 31 and SEQ ID NO: 33, respectively.

Example 3

CRVs for Fast, Synchronized, and High Throughput R-mFRNT to all Four Serotypes of DENV The WNV NY99 strain replicates significantly faster than wild-type DENV in multiple cell cultures, including Vero, LLC-MK2, and BHK-21 cells that are widely used for cell-based neutralization antibody assays. Unlike ELISA that measures all types of antibodies, the neutralization test measures antibodies capable of neutralizing the viruses. Because it is more specific than ELISA, the neutralization test has been used as a confirmative serological assay after positive results of ELISA in diagnosis.

Upon binding to viruses, the neutralization antibodies block virus infection of cells (mostly during virus entry stage) and are the most important B cell immune response product in directly fighting many viral infections. Therefore, the neutralization test is also one of the most important functional immunological assays in analyses of vaccine efficacy. However, most of the cell-based neutralization tests are time-consuming and labor-intensive. The traditional gold-standard plaque-reduction neutralization test (PRNT) used in detecting neutralization antibodies to many flaviviruses typically use 6- to 24-well plates, and require multiple days of cell infection before the virus plaques formed on the infected cell sheet under an agarose medium overlay can be stained and become visible for counting. The faster micro-focus neutralization test (mFRNT) typically uses 96-well micro plates, and the viral micro-foci can be detected and counted by microplate reader (such as ELISPOT reader or image-based cytometry reader) after immunostaining by viral antibodies of the cell sheet within 1-2 days post infection.

PRNT for wild-type dengue viruses typically requires 6 to 9 days, depending on the DENV strain, to produce visible plaques. It was previously determined that chimeric WN/DENVs produce clear plaques by 3 days p.i. (see PCT Publication No. WO 2015/196094). Although much faster and higher throughput than the PRNT, the typical mFRNT is still labor intensive. The procedures include adding and removing the carboxyl methyl cellulose overlays from cell plates, cell fixation, and multiple immunostaining procedures. Chimeric reporter WN/DENVs are used to simplify and optimize the mFRNT to a reporter-based mFRNT (R-mFRNT) that can be live-imaged by an image-based cytometry plate reader to detect the fluorescent viral foci on infected cell sheets. Due to the fast replication efficiency of the WN/DENV and strong ZsGreen reporter signal, the infected cells are measured within 24-26 hours p.i. (FIG. 5). With a live-imaging capable cytometry plate reader, it is possible to directly read infected 96-well plates without any CMC overly, cell fixation, or immunostaining process (FIG. 5 and Table 9).

TABLE 9

| Comparison of three neutralization tests | | | |
|---|---|---|---|
| | PRNT | mFRNT | R-mFRNT |
| Input Virus | Wt DENVs or WN/DENV | Wt DENVs or WN/DENV | R-WN/DENVs |
| Detection | Plaques | Immuno virus foci | Reporter virus foci |
| Procedures after cell infection | Agarose overlay<br>Incubation<br><br>Plaque staining<br>Plaque count | CMC overlay<br>Incubation<br>Cell fixation<br>Immunostaining and image<br>Foci image and count | Live image and foci count |
| Incubation time | Wt DENV: 6-10 days<br>WN/DENVs: 3 days | Wt DENVs: 48 hours<br>WN/DENV: 24-28 hours | R-WN/DENVs: 24-26 hours |
| Plate Format | 6-, 12-, 24-well | 96-, 384-well | 96-, 384-well |
| Labor-intensive | High | High | Low |

A panel of human serum specimens containing monotypic or polytypic DENV NT antibodies were tested by the R-mFRNT using R-WN/DENV-1, R-WN/DENV-2, R-WN/DENV-3 BE345 PP4, and R-WN/DENV-4 (Table 10). The results were comparable to the traditional mFRNT using either wt DENVs or chimeric WN/DENVs without reporter. In addition to the R-mFRNT, R-WN/DENVs can also be used in other single cell-based neutralization assays, which measure reduction of the percent cell infection rate instead of the reduction in viral foci formation (FIGS. 5B and 5C).

TABLE 10

| mFRNT and R-mFRNT of monotypic and polytypic DENY human sera | | | | | | | | | | | | | |
|---|---|---|---|---|---|---|---|---|---|---|---|---|---|
| | | mFRNT$_{90}$ and F-mFRNT$_{90}$ Titers | | | | | | | | | | | |
| Serum ID | Serum type | DENV-1 | WN/D1 | R-WN/D1 | DENV-2 | WN/D2 | R-WN/D2 | DENV-3 | WN/D3 | R-WN/D3 | DENV-4 | WN/D4 | R-WN/D4 |
| 1 | DENV-1 | 160 | 320 | 80 | <10 | <10 | ND | <10 | <10 | ND | <10 | <10 | ND |
| 2 | | 80 | 160 | 80 | <10 | <10 | ND | <10 | <10 | ND | <10 | <10 | ND |
| 3 | | 20 | 40 | 20 | <10 | <10 | ND | <10 | <10 | ND | <10 | <10 | ND |
| 4 | DENV-2 | <10 | <10 | ND | 40 | 80 | 40 | <10 | <10 | ND | <10 | <10 | ND |
| 5 | | <10 | <10 | ND | 80 | 80 | 80 | <10 | <10 | ND | <10 | <10 | ND |
| 6 | | <10 | <10 | ND | 20 | 40 | 20 | <10 | <10 | ND | <10 | <10 | ND |
| 7 | DENV-3 | <10 | <10 | ND | <10 | <10 | ND | 160 | 160 | 80 | <10 | <10 | ND |
| 8 | | <10 | <10 | ND | <10 | <10 | ND | 80 | 80 | 80 | <10 | <10 | ND |
| 9 | | <10 | <10 | ND | <10 | <10 | ND | <10 | <10 | <10 | <10 | <10 | ND |
| 10 | DENV-4 | <10 | <10 | ND | <10 | <10 | ND | <10 | <10 | ND | 160 | 160 | 80 |
| 11 | | <10 | <10 | ND | <10 | <10 | ND | <10 | 10 | ND | 160 | 160 | 60 |
| 12 | | <10 | <10 | ND | <10 | <10 | ND | <10 | <10 | ND | 40 | 40 | 20 |
| 13 | JEV* | <10 | <10 | <10 | <10 | <10 | <10 | <10 | <10 | <10 | <10 | <10 | <10 |
| 16 | Flavi-naïve* | <10 | <10 | <10 | <10 | <10 | <10 | <10 | <10 | <10 | <10 | <10 | <10 |
| 19 | Polytypic | 160 | 160 | 160 | 20 | 25 | 20 | 20 | 80 | 40 | 10 | 20 | <10 |
| 20 | | 80 | 226 | 160 | 57 | 160 | 40 | 160 | 320 | 160 | 28 | 80 | 20 |
| 21 | | 80 | 160 | 60 | 10 | 28 | 20 | 20 | 80 | 40 | <10 | 20 | <10 |
| 25 | | <10 | <10 | <10 | 160 | 320 | 160 | <10 | 10 | 10 | <10 | <10 | <10 |

*JEV: Japanese Encephalitis virus. Flavi-naïve: serum of person without flavivirus antibody In addition to the R-WN/DENVs, a similar CRV was made for Zika virus (ZIKV), R-WN/ZIKV (see WO 2018/009603, incorporated by reference herein, for details of the constructs and their use). Because ZIKV and DENVs are both flaviviruses transmitted by the same mosquito vectors, *Ae. aegypti* and *Ae. albopictus,* these viruses can be endemic in same areas. Due to significant cross-reactivity of antibodies to DENVs and ZIKV, differential diagnosis among these viruses by simple serology test is sometimes difficult, especially in secondary ZIKV- or DENV-infection cases (e.g. previously infected by one DENV serotype and subsequently infected by another serotype of DENV or ZIKV; cross-reactive antibodies would be boosted in the secondary infection). In some of the sero-surveillance studies, vaccine studies, and/or differential diagnosis for DENVs and ZIKV, performing NT against DENVs and ZIKV from the same sample was necessary. As virus replication kinetics are very different among DENVs and ZIKV, the assay duration of NT for each virus could be different. This variation could further complicate the throughput and streamline of the NT. By using the same CRV platform, all of them have similar replication kinetics and can be used to synchronize R-mFRNT results for all 4 DENVs and ZIKV.

In view of the many possible embodiments to which the principles of the disclosed invention may be applied, it should be recognized that the illustrated embodiments are only preferred examples of the invention and should not be taken as limiting the scope of the invention. Rather, the scope of the invention is defined by the following claims. We therefore claim as our invention all that comes within the scope and spirit of these claims.

SEQUENCE LISTING (33 sequences)

SEQ ID NO: 1 - DNA, 11860 bp, Artificial Sequence
  Synthetic construct
  CDS (97)..(11226): Polyprotein
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgcccggaagcggagctactaacttcagcctgctgaagcaggctggagacgtggaggagaaccctggacctatgtccaaaaagcccggcggtcctgggaaatccagagccgtgaacatgttgaaaagggggatgccacgggtactgagtctgatcggcctcaaaagagccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagttcgaaacaaaagaaaagatccgtgaccatgctccttatgctgctgcccacagccctggcgttccatctgacgacacgagggggagagccgcatatgatagttagcaagcaggaaagaggaaagtcacttttgttcaagacctctgcaggtgtcaacatgtgcaccctcatcgcgatggatttgggagagttgtgtgaggacacgatgacctacaaatgcccccggatcactgaggcggaaccagatgacgttgactgttggtgcaatgccacggacacatgggtgacctatggaacgtgctctcaaactggcgaacaccgacgagacaaacgttccgtcgcattggccccacacgtggggcttggcctagaaacaagagccgaaacgtggatgtcctctgaaggtgcttggaaacagatacaaaaagtagagacttgggctctgagacatccaggattcacggtgatagccctttttctagcacatgccataggaacatccatcacccagaaagggatcattttcattttgctgatgctggtaacaccatctatggccatgcgatgcgtgggaataggcaacagagacttcgtggaaggactgtcaggagcaacatgggtggatgtggtactggagcatggaagttgcgtcaccaccatggcaaaaaacaaaccaacactggacattgaactcttgaagacggaggtcacaaaccctgcagttctgcgtaaattgtgcattgaagctaaaatatcaaacaccaccaccgattcgagatgtccaacacaaggagaagccacactggtggaagaacaagacgcgaactttgtgtgccgacgaacgttcgtggacagaggctggggcaatggctgtgggctattcggaaaaggtagtctaataacgtgtgccaagtttaagtgtgtgacaaaactagaaggaaagatagttcaatatgaaaacctaaaatattcagtgatagtcaccgtccacactggagatcagcaccaggtgggaaatgagactacagaacatggaacaactgcaaccataacacctcaagctcctacgtcggaaatacagctgaccgactacggaacccttacattagattgttcacctaggacagggctagattttaacgagatggtgttgctgacaatgaaagaaagatcatggcttgtccacaaacaatggttcctagacttaccactgccttggacctctggggcttcaacatcccaagagacttggaacagacaagatttactggtcacatttaagacagctcatgcaaagaagcaggaagtagtcgtactaggatcacaagaaggagcaatgcacactgcgctgactggagcgacagaaatccaaacgtcaggaacgacaacaattttcgcaggacacctaaaatgcagactaaaaatggacaaactaactttaaaagggatgtcatatgtgatgtgcacaggctcattcaagttagagaaagaagtggctgagacccagcatggaactgttctggtgcaggttaaatatgaaggaacagacgcaccatgcaagattcccttttcgacccaagatgagaaaggagcaacccagaatgggagattaataacagccaaccccatagtcactgacaaagaaaaaccagtcaatattgaggcagaaccaccctttggtgagagctacatcgtggtaggagcaggtgaaaaagctttgaaactaagctggttcaagaaaggaagcagcatagggaaaatgtttgaagcaactgcccgaggagcacgaaggatggccattctgggagacaccgcatgggacttcggttctataggaggagtgttcacgtctatgggaaaactggtacaccaggtttttggaactgcatatggagttttgtttagcggagtttcttggaccatgaaaataggaatagggattctgctgacatggctaggattaaattcaaggaacacgtccctttcgatgatgtgcatcgcagttggcatggtcacactgtacctaggagtcatggttcaggcagattccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 2 - protein, 3710 aa, Artificial Sequence
  Synthetic Construct
MSKKPGGPGKSRAVNMLKRGMPRVLSLIGLKRAMLMAQSKHGLTKEMTMKYRMEGCVDGHKFVITGEGIGYPFKGKQAINLCVVEGGPLPFAEDILSAAFMYGNRVFTEYPQDIADYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSVTMLLMLLPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRAETWMSSEGAWKQIQKVETWALRHPGFTVIALFLAHAIGTSITQKGIIFILLMLVTPSMAMRCVGIGNRDFVEGLSGATWVDVVLEHGSCVTTMAKNKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNETTEHGTTATITPQAPTSEIQLTDYGTLTLDCSPRTGLDFNEMVLLTMKERSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQVKYEGTDAPCKIPFSTQDEKGATQNGRLITANPIVTDKEKPVNIEAEPPFGESYIVVGAGEKALKLSWFKKGSSIGKMFEATARGARRMAILGDTAWDFGSIGGVFTSMGKLVHQVFGTAYGVLFSGVSWTMKIGIGILLTWLGLNSRNTSLSMMCIAVGMVTLYLGVMVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 3 - DNA, 11860 bp, Artificial Sequence
  Synthetic construct
  CDS (97)..(11226): Polyprotein
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgcccggaagcggagctactaacttcagcctgctgaagcaggctggagacgtggaggagaaccctggacctatgtccaaaaagcccggcggtcctgggaaatccagagccgtgaacatgttgaaaagggggatgccacgggtactgagtctgatcggcctcaaaagagccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaagatccgcgggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgttgcagatggaagataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgattccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 4 - protein, 3710 aa, Artificial Sequence
  Synthetic Construct
MSKKPGGPGKSRAVNMLKRGMPRVLSLIGLKRAMLMAQSKHGLTKEMTMKYRMEGCVDGHKFVITGEGIGYPFKGKQAINLCVVEGGPLPFAEDILSAAFMYGNRVFTEYPQDIADYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 5 - DNA, 11866 bp, Artificial Sequence
  Synthetic construct
  CDS (97)..(11232): Polyprotein
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgcccggaagcggagctactaacttcagcctgctgaagcaggctggagacgtggaggagaaccctggacctatgtccaaaaagcccggcggtcctgggaaatccagagccgtgaacatgttgaaaagggggatgccacgggtactgagtctgatcggcctcaaaagagccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagttcgaaacaaaagaaaagaggaggaaagaccggaattctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 6 - protein, 3712 aa, Artificial Sequence
  Synthetic Construct
MSKKPGGPGKSRAVNMLKRGMPRVLSLIGLKRAMLMAQSKHGLTKEMTMKYRMEGCVDGHKFVITGEGIGYPFKGKQAINLCVVEGGPLPFAEDILSAAFMYGNRVFTEYPQDIADYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGILCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 7 - DNA, 11866 bp, Artificial Sequence
  Synthetic construct
  CDS (97)..(11232): Polyprotein
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgcccggaagcggagctactaacttcagcctgctgaagcaggctggagacgtggaggagaaccctggacctatgtccaaaaagcccggcggtcctgggaaatccagagccgtgaacatgttgaaaagggggatgccacgggtactgagtctgatcggcctcaaaagagccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagttcgaaacaaaagaaaagaggaggaaagaccggaattgcagtcatgattggcctgatcgccagcgtaggagctttccacttaacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggaggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 8 - protein, 3712 aa, Artificial Sequence
  Synthetic Construct
MSKKPGGPGKSRAVNMLKRGMPRVLSLIGLKRAMLMAQSKHGLTKEMTMKYRMEGCVDGHKFVITGEGIGYPFKGKQAINLCVVEGGPLPFAEDILSAAFMYGNRVFTEYPQDIADYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGIAVMIGLIASVGAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTEDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 9 - DNA, 11860 bp, Artificial Sequence
  Synthetic construct
  CDS (97)..(11226): Polyprotein
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgcccggaagcggagctactaacttcagcctgctgaagcaggctggagacgtggaggagaaccctggacctatgtccaaaaagcccggcggtcctgggaaatccagagccgtgaacatgttgaaaagggggatgccacgggtactgagtctgatcggcctcaaaagagccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaaggtcaccgataacattgctgtgcttgattcccaccgtaatggcgtttcacttgtcaacaagagatggcgaacccctcatgatagtggcaaaacatgaaagggggagacctctcctgtttaagacaacagaggggatcaacaaatgcactctcattgccatggacttgggtgaaatgtgtgaggacactgtcacgtacaaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtagggaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 10 - protein, 3710 aa, Artificial Sequence
  Synthetic Construct
MSKKPGGPGKSRAVNMLKRGMPRVLSLIGLKRAMLMAQSKHGLTKEMTMKYRMEGCVDGHKFVITGEGIGYPFKGKQAINLCVVEGGPLPFAEDILSAAFMYGNRVFTEYPQDIADYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSPITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 11 - DNA, 11860 bp, Artificial Sequence
  Synthetic construct
  CDS (97)..(11226): Polyprotein
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggcccagtccaagcacggcctgaccaaggagatgaccatgaagtaccgcatggagggctgcgtggacggccacaagttcgtgatcaccggcgagggcatcggctaccccttcaagggcaagcaggccatcaacctgtgcgtggtggagggcggccccttgcccttcgccgaggacatcttgtccgccgccttcatgtacggcaaccgcgtgttcaccgagtacccccaggacatcgtcgactacttcaagaactcctgccccgcaggctacacctgggaccgctccttcctgttcgaggacggcgccgtgtgcatctgcaacgccgacatcaccgtgagcgtggaggagaactgcatgtaccacgagtccaagttctacggcgtgaacttccccgccgacggccccgtgatgaagaagatgaccgacaactgggagccctcctgcgagaagatcatccccgtgcccaagcagggcatcttgaagggcgacgtgagcatgtacctgctgctgaaggacggtggccgcttgcgctgccagttcgacaccgtgtacaaggccaagtccgtgccccgcaagatgcccgactggcacttcatccagcacaagctgacccgcgaggaccgcagcgacgccaagaaccagaagtggcacctgaccgagcacgccatcgcctccggctccgccttgcccggaagcggagctactaacttcagcctgctgaagcaggctggagacgtggaggagaaccctggacctatgtccaaaaagcccggcggtcctggcaagtccagagccgtgaacatgcttaaaagggggatgccacgcgtactgagtctgatcggcctgaagcgggccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaaggtcaccgataacattgctgtgcttgattcccaccgtaatggcgtttcacttgtcaacaagagatggcgaacccctcatgatagtggcaaaacatgaaagggggagacctctcctgtttaagacaacagaggggatcaacaaatgcactctcattgccatggacttgggtgaaatgtgtgaggacactgtcacgtacaaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtagggaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 12 - protein, 3710 aa, Artificial Sequence
  Synthetic Construct
MSKKPGGPGKSRAVNMLKRGMPRVLSLIGLKRAMLMAQSKHGLTKEMTMKYRMEGCVDGHKFVITGEGIGYPFKGKQAINLCVVEGGPLPFAEDILSAAFMYGNRVFTEYPQDIVDYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSPITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 13 - DNA, 87 bp, West Nile virus
aagaaaagaggaggaaagaccggaattgcagtcatgattggcctgatcgccagcgtaggagcagttaccctctctaacttccaaggg

SEQ ID NO: 14 - protein, 29 aa, West Nile virus
KKRGGKTGIAVMIGLIASVGAVTLSNFQG

SEQ ID NO: 15 - DNA, 75 bp, Dengue virus type 1
aggaaaagatccgtgaccatgctccttatgctgctgcccacagccctggcgttccatctgacgacacgaggggga

SEQ ID NO: 16 - protein, 25 aa, Dengue virus type 1
RKRSVTMLLMLLPTALAFHLTTRGG

SEQ ID NO: 17 - DNA, 75 bp, Dengue virus type 2
agacgcagatccgcgggcatgatcattatgctgattccaacagtgatggcgttccatttaaccacacgtaacgga

SEQ ID NO: 18 - protein, 25 aa, Dengue virus type 2
RRRSAGMIIMLIPTVMAFHLTTRNG

SEQ ID NO: 19 - DNA, 75 bp, Dengue virus type 3
cggaaaaagacatcgctctgtctcatgatgatgttaccagcaacacttgctttccacttaacttcacgagatgga

SEQ ID NO: 20 - protein, 25 aa, Dengue virus type 3
RKKTSLCLMMMLPATLAFHLTSRDG

SEQ ID NO: 21 - DNA, 75 bp, Dengue virus type 4
agaaaaaggtcaacgataacattgctgtgcttgattcccaccgtaatggcgtttcacttgtcaacaagagatggc

SEQ ID NO: 22 - protein, 25 aa, Dengue virus type 4
RKRSTITLLCLIPTVMAFHLSTRDG

SEQ ID NO: 23 - DNA, 75 bp, Artificial Sequence
  Chimeric polynucleotide
aagaaaagaacatcgctctgtctcatgatgatgttaccagcaacacttgctttccacttaacttcacgagatgga

SEQ ID NO: 24 - protein, 25 aa, Artificial Sequence
  Chimeric polypeptide
KKRTSLCLMMMLPATLAFHLTSRDG

SEQ ID NO: 25 - protein, 35 aa, West Nile virus
MSKKPGGPGKSRAVNMLKRGMPRVLSLIGLKRAML

SEQ ID NO: 26 - DNA, 105 bp, West Nile virus
atgtctaagaaaccaggagggcccggcaagagccgggctgtcaatatgctaaaacgcggaatgccccgcgtgttgtccttgattggactgaagagggctatgttg

SEQ ID NO: 27 - DNA, 105 bp, Artificial Sequence
  Synthetic polynucleotide
atgtccaaaaagcccggcggtcctgggaaatccagagccgtgaacatgttgaaaagggggatgccacgggtactgagtctgatcggcctcaaaagagccatgttg

SEQ ID NO: 28 - DNA, 11860 bp, Artificial Sequence
  Synthetic construct
  CDS (97)..(11229)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggctcagtcaaagcacggtctaacaaaagaaatgacaatgaaataccgtatggaagggtgcgtcgatggacataaatttgtgatcacgggagagggcattggacatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgcccggaagcggagctactaacttcagcctgctgaagcaggctggagacgtggaggagaaccctggacctatgtccaaaaagcccggcggtcctgggaaatccagagccgtgaacatgttgaaaagggggatgccacgggtactgagtctgatcggcctcaaaagagccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaagatccgcgggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgttgcagatggaagataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaattcacgcagcacctcactgtctgtgacactagtattggtgggaattgtgacactgtatttgggagtcatggtgcaggccgattccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgaccctcttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagctagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 29 - protein, 3710 aa, Artificial Sequence
  Synthetic Construct
MSKKPGGPGKSRAVNMLKRGMPRVLSLIGLKRAMLMAQSKHGLTKEMTMKYRMEGCVDGHKFVITGEGIGHPFKGKQAINLCVVEGGPLPFAEDILSAAFMYGNRVFTEYPQDIADYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMEDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPLQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 30 - DNA, 11866 bp, Artificial Sequence
  Synthetic construct
  CDS (97)..(11235)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggctcagtcaaagcacggtctaacaaaagaaatgacaatgaaataccgtgtggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgcccggaagcggagctactaacttcagcctgctgaagcaggctggagacgtggaggagaaccctggacctatgtccaaaaagcccggcggtcctgggaaatccagagccgtgaacatgttgaaaagggggatgccacgggtactgagtctgatcggcctcaaaagagccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagttcgaaacaaaagaaaagaggaggaaagaccggaagtctctgtctcatgatgatgttaccagcaacacttgctttccacttaacttcacgagatggagagccgcgcatgattgtggggaagaatgaaagaggaaaatccctacttttcaagacagcctctggaatcaacatgtgcacactcatagccatggatctgggagagatgtgtgatgacacggtcacttacaaatgcccccacattaccgaagtggagcctgaagacattgactgctggtgcaaccttacatcgacatgggtgacttatggaacatgcaatcaagctggagagcatagacgcgataagagatcagtggcgttagctccccatgttggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtaggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagtcacggctgagataacaccccaggcatcaaccgctgaagccattttacctgaatatggaaccctcgggctagaatgctcaccacggacaggtttggatttcaatgaaatgatctcattgacaatgaagaacaaagcatggatggtacatagacaatggttctttgacttacccctaccatggacatcaggagctacagcagaaacaccaacttggaacaggaaagagcttcttgtgacatttaaaaatgcacatgcaaaaaagcaagaagtagttgttcttggatcacaagagggagcaatgcatacagcactgacaggagctacagagatccaaacctcaggaggcacaagtatctttgcggggcacttaaaatgtagactcaagatggacaaattggaactcaaggggatgagctatgcaatgtgcttgagtagctttgtgttgaagaaagaagtctccgaaacgcagcatgggacaatactcattaaggttgagtacaaaggggaagatgcaccctgcaagattcctttctccacggtggatggacaaggaaaagctctcaatggcagactgatcacagccaatccagtggtgaccaagaaggaggagcctgtcaacattgaggctgaacctccttttggagaaagtaacatagtaattggaattggagacaaagccctgaaaatcaactggtacaagaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttggtggagtctcctggatgatgaaaattggaataggtgtcctcttaacctggatagggttgaactcaaaaaatacttctatgtcattttcatgcatcgcgataggaatcattacactctatctgggagccgtggtgcaagctgactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacactccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccttatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaaggcgcgaagtgacccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 31 - protein, 3712 aa, Artificial Sequence
  Synthetic Construct
MSKKPGGPGKSRAVNMLKRGMPRVLSLIGLKRAMLMAQSKHGLTKEMTMKYRVEGCVDGHKFVITGEGIGYPFKGKQAINLCVVEGGPLPFAEDILSAAFMYGNRVFTEYPQDIADYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGSLCLMMMLPATLAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEAILPEEQDQNYVCKHTYVDRGWGNGCGLFGKGSLVTCAKFQCLESIEGKVVQHENLKYTVIITVHTGDQHQVGNETQGVTAEITPQASTAEAILPEYGTLGLECSPRTGLDFNEMISLTMKNKAWMVHRQWFFDLPLPWTSGATAETPTWNRKELLVTFKNAHAKKQEVVVLGSQEGAMHTALTGATEIQTSGGTSIFAGHLKCRLKMDKLELKGMSYAMCLSSFVLKKEVSETQHGTILIKVEYKGEDAPCKIPFSTVDGQGKALNGRLITANPVVTKKEEPVNIEAEPPFGESNIVIGIGDKALKINWYKKGSSIGKMFEATARGARRMAILGDTAWDFGSVGGVLNSLGKMVHQIFGSAYTALFGGVSWMMKIGIGVLLTWIGLNSKNTSMSFSCIAIGIITLYLGAVVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 32 - DNA, 11860 bp, Artificial Sequence
  Synthetic construct
  CDS (97)..(11229)
agtagttcgcctgtgtgagctgacaaacttagtagtgtttgtgaggattaacaacaattaacacagtgcgagctgtttcttagcacgaagatctcgatgtctaagaaaccaggagggcccggcaagagccgggctgtcaatatgctaaaacgcggaatgccccgcgtgttgtccttgattggactgaagagggctatgttgatggctcagtcaaagcacggtctaacaaaagaaatgacaatgaaataccgtatggaagggtgcgtcgatggacataaatttgtgatcacgggagagggcattggatatccgttcaaagggaaacaggctattaatctgtgtgtggtcgaaggtggaccattgccatttgccgaagacatattgtcagctgcctttatgtacggaaacagggttttcactgaatatcctcaagacatagctgactatttcaagaactcgtgtcctgctggttatacatgggacaggtcttttctctttgaggatggagcagtttgcatatgtaatgcagatataacagtgagtgttgaagaaaactgcatgtatcatgagtccaaattttatggagtgaattttcctgctgatggacctgtgatgaaaaagatgacagataactgggagccatcctgcgagaagatcataccagtacctaagcaggggatattgaaaggggatgtctccatgtacctccttctgaaggatggtgggcgtttacggtgccaattcgacacagtttacaaagcaaagtctgtgccaagaaagatgccggactggcacttcatccagcataagctcacccgtgaagaccgcagcgatgctaagaatcagaaatggcatctgacagaacatgctattgcatccggatctgcattgcccggaagcggagctactaacttcagcctgctgaagcaggctggagacgtggaggagaaccctggacctatgtccaaaaagcccggcggtcctgggaaatccagagccgtgaacatgttgaaaagggggatgccacgggtactgagtctgatcggcctcaaaagagccatgttgagcctgatcgacggcaaggggccaatacgatttgtgttggctctcttggcgttcttcaggttcacagcaattgctccgacccgagcagtgctggatcgatggagaggtgtgaacaaacaaacagcgatgaaacaccttctgagttttaagaaggaactagggaccttgaccagtgctatcaatcggcggagctcaaaacaaaagaaaaggtcaccgataacattgctgtgcttgattcccaccgtaatggcgtttcacttgtcaacaagagatggcgaacccctcatgatagtggcaaaacatgaaagggggagacctctcctgtttaagacaacagaggggatcaacaaatgcactctcattgccatggacttgggtgaaatgtgtgaggacactgtcacgtacaaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtagggaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaaggaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagactccggatgtgccatagacatcagccggcaagagctgagatgtggaagtggagtgttcatacacaatgatgtggaggcttggatggaccggtacaagtattaccctgaaacgccacaaggcctagccaagatcattcagaaagctcataaggaaggagtgtgcggtctacgatcagtttccagactggagcatcaaatgtgggaagcagtgaaggacgagctgaacactcttttgaaggagaatggtgtggaccttagtgtcgtggttgagaaacaggagggaatgtacaagtcagcacctaaacgcctcaccgccaccacggaaaaattggaaattggctggaaggcctggggaaagagtattttatttgcaccagaactcgccaacaacacctttgtggttgatggtccggagaccaaggaatgtccgactcagaatcgcgcttggaatagcttagaagtggaggattttggatttggtctcaccagcactcggatgttcctgaaggtcagagagagcaacacaactgaatgtgactcgaagatcattggaacggctgtcaagaacaacttggcgatccacagtgacctgtcctattggattgaaagcaggctcaatgatacgtggaagcttgaaagggcagttctgggtgaagtcaaatcatgtacgtggcctgagacgcataccttgtggggcgatggaatccttgagagtgacttgataataccagtcacactggcgggaccacgaagcaatcacaatcggagacctgggtacaagacacaaaaccagggcccatgggacgaaggccgggtagagattgacttcgattactgcccaggaactacggtcaccctgagtgagagctgcggacaccgtggacctgccactcgcaccaccacagagagcggaaagttgataacagattggtgctgcaggagctgcaccttaccaccactgcgctaccaaactgacagcggctgttggtatggtatggagatcagaccacagagacatgatgaaaagaccctcgtgcagtcacaagtgaatgcttataatgctgatatgattgacccttttcagttgggccttctggtcgtgttcttggccacccaggaggtccttcgcaagaggtggacagccaagatcagcatgccagctatactgattgctctgctagtcctggtgtttgggggcattacttacactgatgtgttacgctatgtcatcttggtgggggcagctttcgcagaatctaattcgggaggagacgtggtacacttggcgctcatggcgaccttcaagatacaaccagtgtttatggtggcatcgtttctcaaagcgagatggaccaaccaggagaacattttgttgatgttggcggctgttttctttcaaatggcttattacgatgcccgccaaattctgctctgggagatccctgatgtgttgaattcactggcggtagcttggatgatactgagagccataacattcacaacgacatcaaacgtggttgttccgctgctagccctgctaacacccgggctgagatgcttgaatctggatgtgtacaggatactgctgttgatggtcggaataggcagcttgatcagggagaagaggagtgcagctgcaaaaaagaaaggagcaagtctgctatgcttggctctagcctcaacaggacttttcaaccccatgatccttgctgctggactgattgcatgtgatcccaaccgtaaacgcggatggcccgcaactgaagtgatgacagctgtcggcctaatgtttgccatcgtcggagggctggcagagcttgacattgactccatggccattccaatgactatcgcggggctcatgtttgctgctttcgtgatttctgggaaatcaacagatatgtggattgagagaacggcggacatttcctgggaaagtgatgcagaaattacaggctcgagcgaaagagttgatgtgcggcttgatgatgatggaaacttccagctcatgaatgatccaggagcaccttggaagatatggatgctcagaatggtctgtctcgcgattagtgcgtacaccccctgggcaatcttgccctcagtagttggattttggataactctccaatacacaaagagaggaggcgtgttgtgggacactccctcaccaaaggagtacaaaaagggggacacgaccaccggcgtctacaggatcatgactcgtgggctgctcggcagttatcaagcaggagcgggcgtgatggttgaaggtgttttccacaccctttggcatacaacaaaaggagccgctttgatgagcggagagggccgcctggacccatactggggcagtgtcaaggaggatcgactttgttacggaggaccctggaaattgcagcacaagtggaacgggcaggatgaggtgcagatgattgtggtggaacctggcaggaacgttaagaacgtccagacgaaaccaggggtgttcaaaacacctgaaggagaaatcggggccgtgactttggacttccccactggaacatcaggctcaccaatagtggacaaaaacggtgatgtgattgggctttatggcaatggagtcataatgcccaacggctcatacataagcgcgatagtgcagggtgaaaggatggatgagccaatcccagccggattcgaacctgagatgctgaggaaaaaacagatcactgtactggatctccatcccggcgccggtaaaacaaggaggattctgccacagatcatcaaagaggccataaacagaagactgagaacagccgtgctagcaccaaccagggttgtggctgctgagatggctgaagcactgagaggactgcccatccggtaccagacatccgcagtgcccagagaacataatggaaatgagattgttgatgtcatgtgtcatgctaccctcacccacaggctgatgtctcctcacagggtgccgaactacaacctgttcgtgatggatgaggctcatttcaccgacccagctagcattgcagcaagaggttacatttccacaaaggtcgagctaggggaggcggcggcaatattcatgacagccaccccaccaggcacttcagatccattcccagagtccaattcaccaatttccgacttacagactgagatcccggatcgagcttggaactctggatacgaatggatcacagaatacaccgggaagacggtttggtttgtgcctagtgtcaagatggggaatgagattgccctttgcctacaacgtgctggaaagaaagtagtccaattgaacagaaagtcgtacgagacggagtacccaaaatgtaagaacgatgattgggactttgttatcacaacagacatatctgaaatgggggctaacttcaaggcgagcagggtgattgacagccggaagagtgtgaaaccaaccatcataacagaaggagaagggagagtgatcctgggagaaccatctgcagtgacagcagctagtgccgcccagagacgtggacgtatcggtagaaatccgtcgcaagttggtgatgagtactgttatggggggcacacgaatgaagacgactcgaacttcgcccattggactgaggcacgaatcatgctggacaacatcaacatgccaaacggactgatcgctcaattctaccaaccagagcgtgagaaggtatataccatggatggggaataccggctcagaggagaagagagaaaaaactttctggaactgttgaggactgcagatctgccagtttggctggcttacaaggttgcagcggctggagtgtcataccacgaccggaggtggtgctttgatggtcctaggacaaacacaattttagaagacaacaacgaagtggaagtcatcacgaagcttggtgaaaggaagattctgaggccgcgctggattgacgccagggtgtactcggatcaccaggcactaaaggcgttcaaggacttcgcctcgggaaaacgttctcagatagggctcattgaggttctgggaaagatgcctgagcacttcatggggaagacatgggaagcacttgacaccatgtacgttgtggccactgcagagaaaggaggaagagctcacagaatggccctggaggaactgccagatgctcttcagacaattgccttgattgccttattgagtgtgatgaccatgggagtattcttcctcctcatgcagcggaagggcattggaaagataggtttgggaggcgctgtcttgggagtcgcgacctttttctgttggatggctgaagttccaggaacgaagatcgccggaatgttgctgctctcccttctcttgatgattgtgctaattcctgagccagagaagcaacgttcgcagacagacaaccagctagccgtgttcctgatttgtgtcatgacccttgtgagcgcagtggcagccaacgagatgggttggctagataagaccaagagtgacataagcagtttgtttgggcaaagaattgaggtcaaggagaatttcagcatgggagagtttcttttggacttgaggcctgcaacagcctggtcactgtacgctgtgacaacagcggtcctcactccactgctaaagcatttgatcacgtcagattacatcaacacctcattgacctcaataaacgttcaggcaagtgcactattcacactcgcgcgaggcttccccttcgtcgatgttggagtgtcggctctcctgctagcagccggatgctggggacaagtcaccctcaccgttacggtaacagcggcaacatcccttttttgccactatgcctacatggttcccggttggcaagctgaggcaatgcgctcagcccagcggcggacagcggccggaatcatgaagaacgctgtagtggatggcatcgtggccacggacgtcccagaattagagcgcaccacacccatcatgcagaagaaagttggacagatcatgctgatcttggtgtctctagctgcagtagtagtgaacccgtctgtgaagacagtacgagaagccggaattttgatcacggccgcagcggtgacgctttgggagaatggagcaagctctgtttggaacgcaacaactgccatcggactctgccacatcatgcgtgggggttggttgtcatgtctatccataacatggacactcataaagaacatggaaaaaccaggactaaaaagaggtggggcaaaaggacgcaccttgggagaggtttggaaagaaagactcaaccagatgacaaaagaagagttcactaggtaccgcaaagaggccatcatcgaagtcgatcgctcagcggcaaaacacgccaggaaagaaggcaatgtcactggagggcatccagtctctaggggcacagcaaaactgagatggctggtcgaacggaggtttctcgaaccggtcggaaaagtgattgaccttggatgtggaagaggcggttggtgttactatatggcaacccaaaaaagagtccaagaagtcagagggtacacaaagggcggtcccggacatgaagagccccaactagtgcaaagttatggatggaacattgtcaccatgaagagtggagtggatgtgttctacagaccttctgagtgttgtgacaccctcctttgtgacatcggagagtcctcgtcaagtgctgaggttgaagagcataggacgattcgggtccttgaaatggttgaggactggctgcaccgagggccaagggaattttgcgtgaaggtgctctgcccctacatgccgaaagtcatagagaagatggagctgctccaacgccggtatggggggggactggtcagaaacccactctcacggaattccacgcacgagatgtattgggtgagtcgagcttcaggcaatgtggtacattcagtgaatatgaccagccaggtgctcctaggaagaatggaaaaaaggacctggaagggaccccaatacgaggaagatgtaaacttgggaagtggaaccagggcggtgggaaaacccctgctcaactcagacaccagtaaaatcaagaacaggattgaacgactcaggcgtgagtacagttcgacgtggcaccacgatgagaaccacccatatagaacctggaactatcacggcagttatgatgtgaagcccacaggctccgccagttcgctggtcaatggagtggtcaggctcctctcaaaaccatgggacaccatcacgaatgttaccaccatggccatgactgacactactcccttcgggcagcagcgagtgttcaaagagaaggtggacacgaaagctcctgaaccgccagaaggagtgaagtacgtgctcaacgagaccaccaactggttgtgggcgtttttggccagagaaaaacgtcccagaatgtgctctcgagaggaattcataagaaaggtcaacagcaatgcagctttgggtgccatgtttgaagagcagaatcaatggaggagcgccagagaagcagttgaagatccaaaattttgggagatggtggatgaggagcgcgaggcacatctgcggggggaatgtcacacttgcatttacaacatgatgggaaagagagagaaaaaacccggagagttcggaaaggccaagggaagcagagccatttggttcatgtggctcggagctcgctttctggagttcgaggctctgggttttctcaatgaagaccactggcttggaagaaagaactcaggaggaggtgtcgagggcttgggcctccaaaaactgggttacatcctgcgtgaagttggcacccggcctgggggcaagatctatgctgatgacacagctggctgggacacccgcatcacgagagctgacttggaaaatgaagctaaggtgcttgagctgcttgatggggaacatcggcgtcttgccagggccatcattgagctcacctatcgtcacaaagttgtgaaagtgatgcgcccggctgctgatggaagaaccgtcatggatgttatctccagagaagatcagagggggagtggacaagttgtcacctacgccctaaacactttcaccaacctggccgtccagctggtgaggatgatggaaggggaaggagtgattggcccagatgatgtggagaaactcacaaaagggaaaggacccaaagtcaggacctggctgtttgagaatggggaagaaagactcagccgcatggctgtcagtggagatgactgtgtggtaaagcccctggacgatcgctttgccacctcgctccacttcctcaatgctatgtcaaaggttcgcaaagacatccaagagtggaaaccgtcaactggatggtatgattggcagcaggttccattttgctcaaaccatttcactgaattgatcatgaaagatggaagaacactggtggttccatgccgaggacaggatgaattggtaggcagagctcgcatatctccaggggccggatggaacgtccgcgacactgcttgtctggctaagtcttatgcccagatgtggctgcttctgtacttccacagaagagacctgcggctcatggccaacgccatttgctccgctgtccctgtgaattgggtccctaccggaagaaccacgtggtccatccatgcaggaggagagtggatgacaacagaggacatgttggaggtctggaaccgtgtttggatagaggagaatgaatggatggaagacaaaaccccagtggagaaatggagtgacgtcccatattcaggaaaacgagaggacatctggtgtggcagcctgattggcacaagagcccgagccacgtgggcagaaaacatccaggtggctatcaaccaagtcagagcaatcatcggagatgagaagtatgtggattacatgagttcactaaagagatatgaagacacaactttggttgaggacacagtactgtagatatttaatcaattgtaaatagacaatataagtatgcataaaagtgtagttttatagtagtatttagtggtgttagtgtaaatagttaagaaaattttgaggagaaagtcaggccgggaagttcccgccaccggaagttgagtagacggtgctgcctgcgactcaaccccaggaggactgggtgaacaaagccgcgaagtgatccatgtaagccctcagaaccgtctcggaaggaggaccccacatgttgtaacttcaaagcccaatgtcagaccacgctacggcgtgctactctgcggagagtgcagtctgcgatagtgccccaggaggactgggttaacaaaggcaaaccaacgccccacgcggccctagccccggtaatggtgttaaccagggcgaaaggactagaggttagaggagaccccgcggtttaaagtgcacggcccagcctggctgaagctgtaggtcaggggaaggactagaggttagtggagaccccgtgccacaaaacaccacaacaaaacagcatattgacacctgggatagactaggagatcttctgctctgcacaaccagccacacggcacagtgcgccgacaatggtggctggtggtgcgagaacacaggatct

SEQ ID NO: 33 - protein, 3710 aa, Artificial Sequence
  Synthetic Construct
MSKKPGGPGKSRAVNMLKRGMPRVLSLIGLKRAMLMAQSKHGLTKEMTMKYRMEGCVDGHKFVITGEGIGYPFKGKQAINLCVVEGGPLPFAEDILSAAFMYGNRVFTEYPQDIADYFKNSCPAGYTWDRSFLFEDGAVCICNADITVSVEENCMYHESKFYGVNFPADGPVMKKMTDNWEPSCEKIIPVPKQGILKGDVSMYLLLKDGGRLRCQFDTVYKAKSVPRKMPDWHFIQHKLTREDRSDAKNQKWHLTEHAIASGSALPGSGATNFSLLKQAGDVEENPGPMSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRSPITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRIISSTPLAENTNSATNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQADSGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYYDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGRNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATSLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

The invention claimed is:

1. A chimeric flavivirus nucleic acid molecule comprising in the 5' to 3' direction:

(i) a 5' non-coding region from a West Nile virus (WNV) genome;

(ii) a nucleic acid encoding amino acid residues 1-35 of a capsid (C) protein of the WNV, wherein residues 1-35 of the C protein correspond to residues 289-323 of the polyprotein of SEQ ID NO: 2;

(iii) a reporter gene;

(iv) a nucleic acid encoding a 2A proteolytic site;

(v) a nucleic acid encoding a flavivirus C protein, comprising:

(a) a 5' portion encoding amino acid residues 1-35 of a C protein of the WNV, wherein residues 1-35 of the C protein correspond to residues 289-323 of the polyprotein of SEQ ID NO: 2, and wherein the 5' portion comprises at least one silent mutation; and (b) a 3' portion encoding amino acid residue 36 to the C-terminal most amino acid residue of the flavivirus C protein, wherein residue 36 corresponds to residue 324 of the polyprotein of SEQ ID NO: 2, and wherein the 3' portion comprises a WNV premembrane (prM) signal sequence, a DENV prM signal sequence or a chimeric WNV/DENV prM signal sequence;

(vi) a nucleic acid encoding a prM protein and an envelope (E) protein from the DENV;

(vii) a nucleic acid encoding non-structural proteins NS1, NS2A, NS2B, NS3, NS4A, NS4B and NS5 from the WNV; and (viii) a 3' non-coding region from the WNV genome.

2. The chimeric flavivirus of claim 1, wherein the 3' portion of the nucleic acid encoding the flavivirus C protein encodes amino acid residues 36-123 of the WNV, corresponding to amino acid residues 324-411 of the polyprotein of SEQ ID NO: 8, and comprises a WNV prM signal sequence.

3. The chimeric flavivirus nucleic acid molecule of claim 1, wherein the 3' portion of the nucleic acid encoding the flavivirus C protein encodes amino acid residues 36-105 of the WNV, corresponding to amino acid residues 324-393 of the polyprotein of SEQ ID NO: 2, and comprises a DENV prM signal sequence.

4. The chimeric flavivirus nucleic acid molecule of claim 1, wherein the 3' portion of the nucleic acid encoding the flavivirus C protein encodes amino acid residues 36-111 of the WNV, corresponding to amino acid residues 324-399 of the polyprotein of SEQ ID NO: 6, and comprises a chimeric WNV/DENV prM signal sequence.

5. The chimeric flavivirus nucleic acid molecule of claim 4, wherein the chimeric WNV/DENV prM signal sequence comprises the first six amino acids of the WNV prM signal sequence and the last twelve amino acids of the DENV prM signal sequence.

6. The chimeric flavivirus nucleic acid molecule of claim 1, wherein the reporter gene encodes a fluorescent protein.

7. The chimeric flavivirus nucleic acid molecule of claim 6, wherein the fluorescent protein is a green fluorescent protein (GFP).

8. The chimeric flavivirus nucleic acid molecule of claim 7, wherein the GFP is Zsgreen.

9. The chimeric flavivirus nucleic acid molecule of claim 1, wherein the reporter gene is codon optimized for expression in human cells.

10. The chimeric flavivirus nucleic acid molecule claim 1, wherein the 2A proteolytic site is from porcine teschovirus (PTV) or foot and mouth disease virus (FMDV).

11. The chimeric flavivirus nucleic acid molecule of claim 10, wherein the nucleic acid encoding the 2A proteolytic site comprises the sequence of nucleotides 895-960 of SEQ ID NO: 1.

12. The chimeric flavivirus nucleic acid molecule of claim 1, wherein the 5' portion of the nucleic acid encoding the complete flavivirus C protein comprises at least 10, at least 20 or at least 30 silent mutations.

13. The chimeric flavivirus nucleic acid molecule of claim 12, wherein the 5' portion of the nucleic acid encoding the flavivirus C protein comprises the sequence of nucleotides 961-1065 of SEQ ID NO: 1.

14. The chimeric flavivirus nucleic acid molecule of claim 1, comprising one or more mutations resulting from passage in cell culture.

15. The chimeric flavivirus nucleic acid molecule of claim 1, wherein the WNV is strain NY99.

16. The chimeric flavivirus nucleic acid molecule of claim 1, wherein the DENV is a DENV-1.

17. The chimeric flavivirus nucleic acid molecule of claim 16, wherein the chimeric flavivirus nucleic acid molecule comprises SEQ ID NO: 1.

18. The chimeric flavivirus nucleic acid molecule of claim 1, wherein the DENV is a DENV-2.

19. The chimeric flavivirus nucleic acid molecule of claim 18, wherein the chimeric flavivirus nucleic acid molecule comprises SEQ ID NO: 3 or SEQ ID NO: 28.

20. The chimeric flavivirus nucleic acid molecule of claim 1, wherein the DENV is a DENV-3.

21. The chimeric flavivirus nucleic acid molecule of claim 20, wherein the chimeric flavivirus nucleic acid molecule comprises SEQ ID NO: 5, SEQ ID NO: 7 or SEQ ID NO: 30.

22. The chimeric flavivirus nucleic acid molecule of claim 1, wherein the DENV is a DENV-4.

23. The chimeric flavivirus nucleic acid molecule of claim 22, wherein the chimeric flavivirus nucleic acid molecule comprises SEQ ID NO: 9, SEQ ID NO: 11 or SEQ ID NO: 32.

24. A recombinant virus comprising the chimeric flavivirus nucleic acid molecule of claim 1.

25. A kit comprising the chimeric flavivirus nucleic acid molecule of claim 1.

26. A method of detecting dengue virus neutralizing antibodies in a biological sample, comprising:

contacting the sample with the recombinant virus of claim 24 to form a virus-sample mixture, wherein virus-antibody complexes are formed in the virus-sample mixture if dengue virus-specific antibodies are present in the sample;

inoculating a cell culture with the virus-sample mixture under conditions sufficient to allow infection of the cell culture by any non-neutralized virus and subsequent expression of the reporter gene; and detecting a decrease in expression of the reporter gene in the cell culture as compared to a cell culture inoculated with the recombinant virus contacted with a negative control sample, thereby detecting dengue virus neutralizing antibody in the sample.

27. The method of claim 26, wherein the biological sample comprises a fluid sample.

28. The method of claim 27, wherein the fluid sample comprises blood or serum.

29. A kit comprising the recombinant virus of claim 24.

* * * * *